US009260490B2

(12) United States Patent
Hatzfeld

(10) Patent No.: US 9,260,490 B2
(45) Date of Patent: Feb. 16, 2016

(54) PLANTS HAVING ENHANCED YIELD-RELATED TRAITS AND A METHOD FOR MAKING THE SAME

(75) Inventor: Yves Hatzfeld, Lille (FR)

(73) Assignee: BASF Plant Science Company GmbH, Ludwigshafen (DE)

( * ) Notice: Subject to any disclaimer, the term of this patent is extended or adjusted under 35 U.S.C. 154(b) by 1004 days.

(21) Appl. No.: 13/203,008

(22) PCT Filed: Feb. 19, 2010

(86) PCT No.: PCT/EP2010/052122
§ 371 (c)(1),
(2), (4) Date: Aug. 24, 2011

(87) PCT Pub. No.: WO2010/097343
PCT Pub. Date: Sep. 2, 2010

(65) Prior Publication Data
US 2012/0096592 A1 Apr. 19, 2012

Related U.S. Application Data

(60) Provisional application No. 61/155,182, filed on Feb. 25, 2009, provisional application No. 61/155,180, filed on Feb. 25, 2009, provisional application No. 61/155,192, filed on Feb. 25, 2009, provisional application No. 61/155,179, filed on Feb. 25, 2009, provisional application No. 61/155,177, filed on Feb. 25, 2009, provisional application No. 61/155,185, filed on Feb. 25, 2009, provisional application No. 61/162,733, filed on Mar. 24, 2009, provisional application No. 61/163,469, filed on Mar. 26, 2009.

(30) Foreign Application Priority Data

| Feb. 25, 2009 | (EP) | 09100147 |
| Feb. 25, 2009 | (EP) | 09100148 |
| Feb. 25, 2009 | (EP) | 09100150 |
| Feb. 25, 2009 | (EP) | 09100151 |
| Mar. 24, 2009 | (EP) | 09156049 |
| Mar. 25, 2009 | (EP) | 09004255 |

(51) Int. Cl.
C12N 15/82 (2006.01)
A01H 1/00 (2006.01)
A01H 5/00 (2006.01)
C07K 14/415 (2006.01)
C07K 14/47 (2006.01)
C12N 9/02 (2006.01)
C12N 9/90 (2006.01)

(52) U.S. Cl.
CPC ........... C07K 14/415 (2013.01); C07K 14/4725 (2013.01); C12N 9/0004 (2013.01); C12N 9/90 (2013.01); C12N 15/8261 (2013.01); C12N 15/8271 (2013.01); C12N 15/8273 (2013.01)

(58) Field of Classification Search
None
See application file for complete search history.

(56) References Cited

U.S. PATENT DOCUMENTS 6,171,864 B1 1/2001 Coughlan et al.
7,834,146 B2 * 11/2010 Kovalic et al. ............... 530/350
2004/0123343 A1 6/2004 La Rosa et al.

FOREIGN PATENT DOCUMENTS

| EP | 1586645 A2 | 10/2005 |
| WO | WO-01/83789 A2 | 11/2001 |
| WO | WO 02/066660 A2 | 8/2002 |
| WO | WO-2005/120215 A1 | 12/2005 |
| WO | WO-2009/013750 A2 | 1/2009 |

OTHER PUBLICATIONS

GenBank Accession No. NP_176030.1, Calreticulin-1 from Arabidopsis thaliana, Submitted Aug. 13, 2001.*
Jin et al, Transgenic Research (2005) 14:619-624.*
International Preliminary Report on Patentability for PCT/EP2010/052122, issued Aug. 30, 2011.
Aasland, R., et. al., "Protein Sequence Motifs—The PHD finger: Implications for chromatin-mediated transcriptional regulation", TIBS 20, (1995), pp. 56-59.
Akesson, A., et. al., "Overexpression of the $Ca^{2+}$-binding protein calreticulin in the endoplasmic reticulum improves growth of tobacco cell suspensions (Nictotiana tabacum) in high-$Ca^{2+}$ medium", Physiologia Plantarum, vol. 123, (2005), pp. 92-99.
Bishop, A., et. al., "Identification of the tRNA-Dihydrouridine Synthase Family", The Journal of Biological Chemistry, vol. 277, No. 28, (2002), pp. 25090-25095.
Callebaut, I., et. al., "The BAH (bromo-adjacent homology) domain: a link between DNA methylation, replication and transcriptional regulation", FEBS Letters, vol. 446, (1999), pp. 189-193.
Christensen, A., et. al., "Functional Characterization of Arabidopsis Calreticulin1a: Key Alleviator of Endoplasmic Reticulum Stress", Plant Cell Physiol., vol. 49, No. 6, (2008), pp. 912-924.
Hassan, A., et. al., "Calreticulin is the Major $C_a^2+$ Storage Protein in the Endoplasmic Reticulum of the Pea Plant (Pisum sativum)", Biochemical and Biophysical Research Communications, vol. 211, No. 1, (1995), pp. 54-59.
Hrubá, P., et. al., "Expression and thermotolerance of calreticulin during pollen development in tobacco", Sex Plant Reprod., vol. 18, (2005), pp. 143-148.
Hueros, G., et. al., "Molecular Characterization of BET1, a Gene Expressed in the Endosperm Transfer Cells of Maize", The Plant Cell, vol. 7, (1995), pp. 747-757.
Jacobson, M., et. al., "Determination of 5,6 Dihydrouridine in Ribonucleic Acid", Analytical Biochemistry, vol. 34, (1970), pp. 459-469.
Jia, X., et. al., "Calreticulin: conserved protein and diverse functions in plants", Physiologia Plantarum, vol. 136, (2009), pp. 127-138.
Jin, Z., et. al., "Over-expression of Chinese cabbage calreticulin 1, BrCRT1, enhances shoot and root regeneration, but retards plant growth in transgenic tobacco", Transgenic Research, vol. 14, (2005), pp. 619-626.
Klosterman, S., et. al., Plant HMG proteins bearing the AT-hook motif, Plant Science, vol. 162, (2002), pp. 855-866.
Michalak, M., et. al., "Calreticulin, a multi-process calcium-buffering chaperone of the endoplsmic reticulum", Biochem J., vol. 417, (2009), pp. 651-666.
Michalak, M., et al., "Calreticulin", Biochem J., vol. 285, (1992), pp. 681-692.

(56) References Cited

OTHER PUBLICATIONS

Müssig, C., et. al., "The Arabidopsis PHD-finger protein SHL is required for proper development and fertility", Mol. Gen. Genet., vol. 264, (2000), pp. 363-370.
Navazio, L., et. al., "Evidence that Spinach Leaves Express Calrecticulin but Not Calsequestrin", Plant Physiol., vol. 109, (1995), pp. 983-990.
Pascual, J., et. al., "Structure of the PHD Zinc Finger from Human Williams-Beuren Syndrome Transcription Factor", J. Mol. Biol., vol. 304, (2000), pp. 723-729.
Piñeiro, M., et. al., "Early Bolting in Short Days is Related to Chromatin Remodeling Factors and Regulates Flowering in Arabidopsis by Repressing FT", The Plant Cell, vol. 15, (2003), pp. 1552-1562.
Speulman, E., et. al., "A barley cDNA clone with homology to the DNA-binding domain of the steroid hormone receptors", Plant Science, vol. 106, (1995), pp. 91-98.

* cited by examiner

*Primary Examiner* — Shubo (Joe) Zhou
*Assistant Examiner* — Mykola Kovalenko
(74) *Attorney, Agent, or Firm* — Drinker Biddle & Reath LLP

(57) ABSTRACT

The present invention relates generally to the field of molecular biology and concerns a method for enhancing yield related traits by modulating expression in a plant of a nucleic acid encoding a BET1-like polypeptide. The present invention also concerns plants having modulated expression of a nucleic acid encoding this BET1-like polypeptide, which plants have enhanced yield-related traits relative to corresponding wild type plants or other control plants. The invention also provides constructs useful in the methods of the invention.

The present invention relates generally to the field of molecular biology and concerns a method for improving various plant growth characteristics by modulating expression in a plant of a nucleic acid encoding a CRT (Calreticulin). The present invention also concerns plants having modulated expression of a nucleic acid encoding a Calreticulin, which plants have improved growth characteristics relative to corresponding wild type plants or other control plants. The invention also provides hereto unknown Calreticulin polynucleotides, polypeptides and constructs useful in the methods of the invention.

The present invention relates generally to the field of molecular biology and concerns a method for increasing various plant yield-related traits by increasing expression in a plant of a nucleic acid sequence encoding a tRNA dihydrouridine synthase 1-like (DUS1L) polypeptide. The present invention also concerns plants having increased expression of a nucleic acid sequence encoding a DUS1L polypeptide, which plants have increased yield-related traits relative to control plants. The invention additionally relates to nucleic acid sequences, nucleic acid constructs, vectors and plants containing said nucleic acid sequences.

The present invention relates generally to the field of molecular biology and concerns a method for enhancing yield-related traits by modulating expression in a plant of a nucleic acid encoding an ES43-like polypeptide. The present invention also concerns plants having modulated expression of a nucleic acid encoding an ES43_like polypeptide, which plants have improved growth characteristics relative to corresponding wild type plants or other control plants. The invention also provides hereto unknown ES43-like polynucleotides and polypeptides and constructs useful in the methods of the invention.

The present invention relates generally to the field of molecular biology and concerns a method for enhancing various economically important yield-related traits in plants. More specifically, the present invention concerns a method for enhancing yield-related traits in plants by modulating expression in a plant of a nucleic acid encoding an HON5-like polypeptide. The present invention also concerns plants having modulated expression of a nucleic acid encoding an HON5-like polypeptide, which plants have enhanced yield-related traits relative to control plants. The invention also provides hitherto unknown HON5-like-encoding nucleic acids, and constructs comprising the same, useful in performing the methods of the invention.

The present invention relates generally to the field of molecular biology and concerns a method for enhancing yield-related traits in plants by modulating expression in a plant of a nucleic acid encoding a glutamate-1-semialdehyde aminotransferase (GSA1) polypeptide. The present invention also concerns plants having modulated expression of a nucleic acid encoding a GSA1, which plants have enhanced yield-related traits relative to corresponding wild type plants or other control plants. The invention also provides constructs useful in the methods of the invention.

14 Claims, 52 Drawing Sheets

MAVMKSSTMVALLLAVAILSSLSPCYE

AGGCIGKPKKSPPPPRKPYFSSYSEDH

|  | 1 | 50 |
|---|---|---|
| A.arenosa_x_thaliana_TA52_378006_1 | (1) | -------------------------------------------------- |
| B.napus_BN06MS42331943.f_k04_1_40488_1 | (1) | -------------------------------------------------- |
| V.corymbosum_CV091429_1 | (1) | -------------------------------------------------- |
| V.corymbosum_TA638_69266_1 | (1) | -------------------------------------------------- |
| B.vulgaris_DV501764_1 | (1) | -------------------------------------------------- |
| B.pendula_CD278481_1 | (1) | -------------------------------------------------- |
| C.reticulata_x_temple_DN795225_1 | (1) | -------------------------------------------------- |
| P.dulcis_TA313_3755_1 | (1) | -------------------------------------------------- |
| V.riparia_TA839_96939_1 | (1) | -------------------------------------------------- |
| L.serriola_TA5233_75943_1 | (1) | -------------------------------------------------- |
| S.indicum_TA1114_4182_1 | (1) | -----------------------------------------------ME |
| G.biloba_DR064764_1 | (1) | -------------------------------------------------- |
| P.abies_TA1522_3329_1 | (1) | -----------------------------------------------MA |
| P.sitchensis_TA10405_3332_1 | (1) | -----------------------------------------------MA |
| P.abies_TA1523_3329_1 | (1) | -----------------------------------------------MA |
| P.engelmannii_x_glauca_CO203682_1 | (1) | MPGLDESRGLPKPEEYDLTTFSTCPPFLTTPDPKLSSVWCGRTERRSIMA |
| P.pinaster_BX678743_1 | (1) | -----------------------------------------------MA |
| P.taeda_TA16676_3352_1 | (1) | -----------------------------------------------MA |
| P.pinaster_TA4882_71647_1 | (1) | -----------------------------------------------MA |
| P.taeda_TA3629_3352_1 | (1) | -----------------------------------------------MA |
| P.abies_TA2417_3329_1 | (1) | -----------------------------------------------MA |
| P.menziesii_TA1952_3357_1 | (1) | ----------------------------------------------MAG |
| P.pinaster_BX682074_1 | (1) | -------------------------------------------------- |
| P.taeda_TA22888_3352_1 | (1) | -------------------------------------------------- |
| P.pinaster_CR392675_1 | (1) | -------------------------------------------------- |
| P.pinaster_TA4836_71647_1 | (1) | -------------------------------------------------- |
| P.taeda_CO162523_1 | (1) | -------------------------------------------------- |
| P.taeda_TA4949_3352_1 | (1) | -------------------------------------------------- |
| T----M---_25296 | (1) | ----------------------------------------------MAV |
| Z.mays_DR787277_1 | (1) | ----------------------------------------------MAV |
| Z.mays_ZM07MC13625_57676372_13595_1 | (1) | ----------------------------------------------MAV |
| Z.mays_c62091609gm030403_7698_1 | (1) | ----------------------------------------------MAV |
| Z.mays_DQ245377_1 | (1) | ----------------------------------------------MAV |
| Z.mays_EC364520_1 | (1) | ----------------------------------------------MAV |
| Z.mays_c57759235gm030403_14494_1 | (1) | ---------------------------------------------MMAL |
| A.majus_AJ789814_1 | (1) | -------------------------------------------------- |
| P.coccineus_TA3810_3886_1 | (1) | -------------------------------------------------- |
| C.tetragonoloba_EG981304_1 | (1) | -------------------------------------------------- |
| M.truncatula_AC169182_23.5_1 | (1) | -------------------------------------------------- |
| G.max_TA67390_3847_1 | (1) | -------------------------------------------------- |
| C.tetragonoloba_EG987480_1 | (1) | -------------------------------------------------- |
| M.truncatula_AC169182_39.5_1 | (1) | -------------------------------------------------- |
| A.hypogaea_EE124570_1 | (1) | -------------------------------------------------- |
| P.coccineus_CA908259_1 | (1) | -------------------------------------------------- |
| P.coccineus_CA908272_1 | (1) | -------------------------------------------------- |
| P.coccineus_TA2699_3886_1 | (1) | -------------------------------------------------- |
| A.thaliana_AT1G56233.1_1 | (1) | ----------------------------------------------MTT |
| B.napus_CD815839_1 | (1) | ----------------------------------------------MTT |
| Consensus | (1) |  |

FIGURE 2

```
                                            51                                                  100
       A.arenosa_x_thaliana_TA52_378006_1   (1) -----MKLSLRFLSVLLLISFMVLATTAEVSPVDN----KICKTRSDRFS
 B.napus_BN06MS42331943.f_k04_1_40488_1     (1) ---MEASRKVFSAMLLMVLLLAATGEM---GGPVMVADARTCESQSHRFK
              V.corymbosum_CV091429_1        (1) ---MSRSVHWVSTIFLVVMLLMASTEM---GGR--VAEGRTCESQSQRFK
              V.corymbosum_TA638_69266_1     (1) ---MRRSVHWVSAIFLVVVLLMASTEM----GGIG-VAEGRTCESQSQRFK
                   B.vulgaris_DV501764_1     (1) ---MKLSMKPFAAIFLVLLLVLATEIG------PRVAEARTCGTPSQRFR
                   B.pendula_CD278481_1      (1) ------MATKSLGLFPFFLIIFASQEM---VRP---SEARVCESKSHNFK
        C.reticulata_x_temple_DN795225_1     (1) --------MKSFFGIFLLLILFASQEM---MVP---AEGRVCQSQSHHFH
                    P.dulcis_TA313_3755_1    (1) -----MERKSCIALVLLLFIVLASQEM---VVP---SEARVCQSQSHGFR
                  V.riparia_TA839_96939_1    (1) -----MERKSLGIFFFLLLILLASQEM---VVP---SEARVCESQSHKFE
               L.serriola_TA5233_75943_1     (1) --MVKISINGVFLVLLLLLVTYEEERGGSGTVMMMMAEGRTCESQSHGFK
                  S.indicum_TA1114_4182_1    (3) KKIGQWSGGAATACLVFLLLLLASREG---IMVEG----RTCESQSHGFK
                       G.biloba_DR064764_1   (1) --MAKRMGSLSVFLVVLVLVISLEMQA---EVAEA----RTCKTQSSKFK
                    P.abies_TA1522_3329_1    (3) GKGVGGRLSALFLLVLLVISIG-MMQV---EVAEA----RMCKTPSSKFK
               P.sitchensis_TA10405_3332_1   (3) GKGVRGRLSALFLLVLLVISIG-MMQV---EVAEA----RMCKTPSSKFK
                    P.abies_TA1523_3329_1    (3) AKGVGGRLSALF---LLVISIG-MMQV---EVAEA----RMCKTPSSKFK
      P.engelmannii_x_glauca_CO203682_1     (51) AKGVGGRLSALFLLVLLVISIG-MMQV---EVAEA----RMCKTPSSKFK
                   P.pinaster_BX678743_1     (3) AKGVGTRLSALFLVVLFVISIG-IMEV---QVAEG----RMCKTPSGKFK
                   P.taeda_TA16676_3352_1    (3) GKGVGTRLIALFLVVLLVISIG-MMEV---QVAEG----RMCKTPSGKFK
                 P.pinaster_TA4882_71647_1   (3) RSGLRTRFSALFLLVLLVITMGMMMEV---QVAEG----RMCKTPSSKFK
                    P.taeda_TA3629_3352_1    (3) GNGVGNRLSALFLLMLFVITIGMMMEV---QVAEG----RMCKTPSGKFK
                    P.abies_TA2417_3329_1    (3) DKGVGSRLSAIFLLVLLVISIG-MMQL---EPAEG----RTCKTPSGKFK
                 P.menziesii_TA1952_3357_1   (4) KLGVASRLSTLFLLVLLVMSIG-MVQV---EVAEA----RQCKTESSKFK
                   P.pinaster_BX682074_1     (1) ----MATMTRVAFVLLLIFVITLELQV---EGVAG---NRTCKARSHKFK
                    P.taeda_TA22888_3352_1   (1) ----MASFSRVALVLLLIFVITIELQV---ESVAG---TRTCKARSHKFK
                    P.pinaster_CR392675_1    (1) ----MATMTRVAFVLLLIFAITLEIQV---DGEMQIDGVAECKAISHKFK
                 P.pinaster_TA4836_71647_1   (1) ----MATMTRVACVLLLILAITLDGVA---G-------ERQCKAISHKFK
                     P.taeda_CO162523_1      (1) ----MATMTRVVFVLLLIFVIALDMQV---DGVAG---ERVCKAVSHKFK
                    P.taeda_TA4949_3352_1    (1) ----MATMTRVAFVLLLIFVIALEMPV---DGVAG---ERECKAVSHKFK
                         T----M---_25296     (4) MKSS--TMVALLLAVAILSSLSPCYEA---GGCIGKPKKSPPPPRKPYFS
                           Z.mays_DR787277_1  (4) MKSS--TIVALLLAVAILSSLSPCYEA---GGCIGKPKKSPPPPRRPYFS
      Z.mays_ZM07MC13625_57676372_13595_1    (4) MKSS--TIVALLLAVAILSSLSPCYEA---GGCIGKPKKSPPPPRRPYFS
           Z.mays_c62091609gm030403_7698_1   (4) MKSRTVIVAAVLLAVVILSSLCPCYEA---GGCIGKPPKTPAP-KRPCFS
                           Z.mays_DQ245377_1  (4) MKSRTVVVAAVLLAVVILSSLCPCYEA---GGCIGKPPKTPAP-KRPCFS
                           Z.mays_EC364520_1  (4) MKSSTVVVAAVLLAVVILSSLSPCYEA---GGCIGKPPKTPAP-KRPCFS
           Z.mays_c57759235gm030403_14494_1  (5) NGGWRKTFVSILTTCFLVVVIVSLSCEAKGGVVPRLRPPFCFPYDREYC
                            A.majus_AJ789814_1 (1) ---MGFNASSKCFAGIICLICILTSGQTVEAIR---------------EP
                   P.coccineus_TA3810_3886_1  (1) ----MKMIKSLIFFQILCIAVLLTSGTS------SDTPILRHEIVCHVGG
                 C.tetragonoloba_EG981304_1   (1) ---MAFHIYQQYLLVILCIALILAFEVTN--G--------------YPLG
                 M.truncatula_AC169182_23.5_1 (1) ---MAFSFYQSFLFLILCIALVLPSG-----LAIGSVPDFQCIAPCEGLP
                      G.max_TA67390_3847_1    (1) ---MAFHIYQRPYVLSVICIAMIFAAG----VVTCFESPLLS--------
                 C.tetragonoloba_EG987480_1   (1) -MMTSRVTTLLHLVCIVLIILFTEWGYEKKMMSGEAAVMDSQVLMGAETN
                 M.truncatula_AC169182_39.5_1 (1) --------------MVFLSGFATSFGG--------------DPPGLRCR
                      A.hypogaea_EE124570_1    (1) -MASPISQPYSLGILCIFFTLASTGPLFADGTTLFPG--RVCD-------
                   P.coccineus_CA908259_1     (1) -MTSRFCHPFLFNVLLVALVLTSDLNV---GGGAVAEPVTGMIDEDLRCF
                   P.coccineus_CA908272_1     (1) -MAFRLCHSFLFSVLFVALVLTS-------GGGAVAEPVTGMIDEDLRCF
                   P.coccineus_TA2699_3886_1  (1) -MASRFCHSFLFSVLFVALVLTS-------GGGAVAEPVTGMIDEDLRCF
                       A.thaliana_AT1G56233.1_1 (4) KKFLPLLLSSLMVYSLILLPIISGKSP---------------------
                           B.napus_CD815839_1  (4) KKMSSLLLFSLMVFILVSLPIISGDECTP--------------------K-
                               Consensus    (51)        L AL LVVLLLL  I       V          R C  S KFK
```

FIGURE 2 (continued)

```
                                            101                                              150
      A.arenosa_x_thaliana_TA52_378006_1   (42) ----------GVCLST----NNCAIICQQFEHFD--GCHCEF----DCAL
B.napus_BN06MS42331943.f_k04_1_40488_1     (45) ----------GPCARK----ANCAIVCNTEGFPD--GDWHG-------VL
            V.corymbosum_CV091429_1         (43) ----------GTCARK----SNCAAVCQTEGFQG--GICRG-------FR
          V.corymbosum_TA638_69266_1        (44) ----------GPCSTD----RNCGSVCETEGFQG--GNCRG-------FR
              B.vulgaris_DV501764_1         (42) ----------GLCVRK----RNCESVCNSEGFPD--GSCQG-------AR
                B.pendula_CD278481_1        (39) ----------GPCVSD----QNCGMVCRNEGFSA--GDCKG-------LR
       C.reticulata_x_temple_DN795225_1     (38) ----------GACFSH----HNCAYVCRNEGFSG--GKCRG-------AR
                P.dulcis_TA313_3755_1       (40) ----------GPCIRH----HNCALVCRNEGFSG--GRCRG-------FR
              V.riparia_TA839_96939_1       (40) ----------GACVGD----HNCALVCRNEGFSG--GKCKG-------FR
             L.serriola_TA5233_75943_1      (49) ----------GRCVSN----NNCGLVCKNEGFSG--GWCRG-------LR
              S.indicum_TA1114_4182_1       (46) ----------GRCVTS----HNCGLVCRNEGFTD--GWCRG-------FR
                G.biloba_DR064764_1         (42) ----------GYCLSD----TNCRNVCRTEGFPT--GSCDF-----HVAS
                P.abies_TA1522_3329_1       (45) ----------GYCVSS----TNCKNVCRTEGFPT--GSCDF-----HVAS
            P.sitchensis_TA10405_3332_1     (45) ----------GYCVSS----TNCKNVCRTEGFPT--GSCDF-----HVAS
                P.abies_TA1523_3329_1       (42) ----------GYCVSS----TNCKNVCRTEGFPT--GSCDF-----HVAS
      P.engelmannii_x_glauca_CO203682_1     (93) ----------GYCVSS----TNCKNVCRTEGFPT--GSCDF-----HVAG
                P.pinaster_BX678743_1       (45) ----------GYCVSS----TNCKSVCRTEGFPT--GSCDF-----HVAS
                P.taeda_TA16676_3352_1      (45) ----------GYCVSS----TNCENVCRTEGFPT--GSCDF-----HVAS
            P.pinaster_TA4882_71647_1       (46) ----------GYCVRS----TNCKNICRTEGFPT--GSCDF-----HVAN
                P.taeda_TA3629_3352_1       (46) ----------GYCVRS----TNCKNICRTEGFPT--GSCDF-----HVAN
                P.abies_TA2417_3329_1       (45) ----------GVCASS----NNCKNVCQTEGFPS--GSCDF-----HVAN
            P.menziesii_TA1952_3357_1       (46) ----------GYCGSS----TNCKNVCRTEGFPA--GSCDF-----HVAS
                P.pinaster_BX682074_1       (41) ----------GHCGKD----SNCKAICKTEGFDE--GSCHH-----HVHK
                P.taeda_TA22888_3352_1      (41) ----------GHCGKN----ANCKAICKTEGFEE--GSCHH-----HVLK
                P.pinaster_CR392675_1       (44) ----------GRCEKD----ANCKTICKTEGFED--GSCHHT----HLLK
            P.pinaster_TA4836_71647_1       (37) ----------GRCEKD----ANCKTVCKTEGFED--GSCHHT----HLLK
                P.taeda_CO162523_1          (41) ----------GHCEKD----ANCKSICKTEGFED--GSCHHT----HLLK
                P.taeda_TA4949_3352_1       (41) ----------GHCEKD----ANCKSICKTEGFED--GSCHHT----HHLK
                T----M---_25296             (49) ----------SYSED----HQNCRLICSSKGFKD--GGWCDE----SVEH
                Z.mays_DR787277_1           (49) ----------SYSED----HQNCRLICSSKGFKD--GGWCDE----SVEH
   Z.mays_ZM07MC13625_576763721_3595_1      (49) ---------SYSEDHQKDHQNCRLICSSKGFKD--GGWCDE----SVEH
      Z.mays_c62091609gm030403_7698_1       (50) ---------PYSEDH-CDRQNCRFVCMSHGYSD--GGWCDE----REVR
                Z.mays_DQ245377_1           (50) ---------PYSEDH-CDRQNCRFVCMSHGYSD--GGWCDE----REVR
                Z.mays_EC364520_1           (50) ---------PYSEDH-CDRQNCRFVCMSHGYSD--GGWCDE----REVR
    Z.mays_c57759235gm030403_14494_1        (55) TP----------------FHCGKVCQEYNFPAKNGGYCDKRG----DP
                A.majus_AJ789814_1          (33) ----------VACIGNCSAFKNCQKACVAKGYRR--GGACFGYS---KQN
           P.coccineus_TA3810_3886_1        (41) ----------GACPDP----KGCMFFCQITGYKN--GGYCIP-----RGS
          C.tetragonoloba_EG981304_1        (32) ---------ELSCGGDCINIATCNRNCILNGFKK--GGLCVIQ----LKT
          M.truncatula_AC169182_23.5_1      (43) ------------------EQCPVFCNTRGFKR--GGGCQVR----PNG
                G.max_TA67390_3847_1        (36) ------------CQERCIDDPTCDFICHKKGFVK--GGSCKP----IILY
          C.tetragonoloba_EG987480_1        (50) NMKCCYDNLVPKCIPNTSDDANCNDMCVNNGFCK--GGFCKILRYKKPSN
          M.truncatula_AC169182_39.5_1      (22) ----------GQCKDP----QQCNQFCLNNGFKK--GGVCLASGA-NPNF
                A.hypogaea_EE124570_1       (41) ----------EPCQGYG----NCATSCVQKGFRG--GSCIGV----IPRV
              P.coccineus_CA908259_1        (47) ----------GLCTGN-----CKEDCASKGFKS--GFCIQ-----QGSL
              P.coccineus_CA908272_1        (43) ----------GLCTGN------CKEDCASKGFKS--GFCVQ-----QGSL
           P.coccineus_TA2699_3886_1        (43) ----------GLCTGN------CKEDCASKGFKS--GFCVQ-----QGSL
             A.thaliana_AT1G56233.1_1       (31) ----------VSCDGACTSTPQCNKICTSKGYKK--GICHG----SAHLF
                B.napus_CD815839_1          (34) ----------GPCEDT----KKCNIYCLLLGFKY--GGFCDTYG-----T
                         Consensus          (101)          G C          NCK VC TEGF    G C
```

FIGURE 2 (continued)

|  |  | 151 | 174 |
|---|---|---|---|
| A.arenosa_x_thaliana_TA52_378006_1 | (72) | RRCMCTKQCNN-------------- | |
| B.napus_BN06MS42331943.f_k04_1_40488_1 | (72) | ILCMCSKPCS--------------- | |
| V.corymbosum_CV091429_1 | (70) | RRCFCTKHCA--------------- | |
| V.corymbosum_TA638_69266_1 | (71) | RRCFCTKHCME-------------- | |
| B.vulgaris_DV501764_1 | (69) | RRCICNRPCAK-------------- | |
| B.pendula_CD278481_1 | (66) | RRCFCTRSC---------------- | |
| C.reticulata_x_temple_DN795225_1 | (65) | RRCFCSKLC---------------- | |
| P.dulcis_TA313_3755_1 | (67) | RRCFCTRLC---------------- | |
| V.riparia_TA839_96939_1 | (67) | RRCFCTKLC---------------- | |
| L.serriola_TA5233_75943_1 | (76) | GMCFCTKDC---------------- | |
| S.indicum_TA1114_4182_1 | (73) | GRCFCTRPC---------------- | |
| G.biloba_DR064764_1 | (71) | RKCYCYKPCV--------------- | |
| P.abies_TA1522_3329_1 | (74) | RKCYCYKPCP--------------- | |
| P.sitchensis_TA10405_3332_1 | (74) | RKCYCYKPCP--------------- | |
| P.abies_TA1523_3329_1 | (71) | RKCYCYKPCP--------------- | |
| P.engelmannii_x_glauca_CO203682_1 | (122) | RKCYCYKPCP--------------- | |
| P.pinaster_BX678743_1 | (74) | RKCYCYKPCP--------------- | |
| P.taeda_TA16676_3352_1 | (74) | RKCYCYKPCP--------------- | |
| P.pinaster_TA4882_71647_1 | (75) | RKCYCYKPCP--------------- | |
| P.taeda_TA3629_3352_1 | (75) | RKCYCYKPCP--------------- | |
| P.abies_TA2417_3329_1 | (74) | RKCYCSKPCP--------------- | |
| P.menziesii_TA1952_3357_1 | (75) | RKCYCSKPCLDV------------ | |
| P.pinaster_BX682074_1 | (70) | KRCFCEKPC---------------- | |
| P.taeda_TA22888_3352_1 | (70) | KRCFCEKPC---------------- | |
| P.pinaster_CR392675_1 | (74) | KKCLCSKHC---------------- | |
| P.pinaster_TA4836_71647_1 | (67) | EKCLCSKHC---------------- | |
| P.taeda_CO162523_1 | (71) | KKCLCSKHC---------------- | |
| P.taeda_TA4949_3352_1 | (71) | KKCLCSKHC---------------- | |
| T----M---_25296 | (79) | KVCCCSH------------------ | |
| Z.mays_DR787277_1 | (79) | KVCCCSH------------------ | |
| Z.mays_ZM07MC13625_57676372_13595_1 | (83) | KVCCCSH------------------ | |
| Z.mays_c62091609gm030403_7698_1 | (83) | KMCCCYH------------------ | |
| Z.mays_DQ245377_1 | (83) | KLCCCYH------------------ | |
| Z.mays_EC364520_1 | (83) | KLCCCYH------------------ | |
| Z.mays_c57759235gm030403_14494_1 | (83) | WKCCCPY------------------ | |
| A.majus_AJ789814_1 | (68) | LTCCCNRGW---------------- | |
| P.coccineus_TA3810_3886_1 | (70) | ERCCCIL------------------ | |
| C.tetragonoloba_EG981304_1 | (67) | SVCCCKT------------------ | |
| M.truncatula_AC169182_23.5_1 | (67) | KKCCCLPNPPELR------------ | |
| G.max_TA67390_3847_1 | (68) | FLCCCMK------------------ | |
| C.tetragonoloba_EG987480_1 | (98) | RYCHCAC------------------ | |
| M.truncatula_AC169182_39.5_1 | (55) | KICCCHS------------------ | |
| A.hypogaea_EE124570_1 | (71) | ILCCCFKH----------------- | |
| P.coccineus_CA908259_1 | (74) | NQCCCL------------------- | |
| P.coccineus_CA908272_1 | (70) | NQCCCL------------------- | |
| P.coccineus_TA2699_3886_1 | (70) | NQCCCL------------------- | |
| A.thaliana_AT1G56233.1_1 | (65) | YICCCYAKFESQYDPSISSPPNY- | |
| B.napus_CD815839_1 | (63) | TFCCCITSKTPPISSLPEH------ | |
| Consensus | (151) | RKC C K C | |

FIGURE 2 (continued)

```
                                              1                                                  50
       A.formosa_TA8804          (1) ---------------------MAKLASINSTSCTKYKLLLLQFLLLSLYF
       C.maculosa_TA223          (1) ------------------------MSNHGVGRSSSLSLIFGALLFVLLSI
       P.trifoliata_TA7309       (1) ----------------------------------MMLKLLVLFLF
       E.esula_TA10075           (1) -------------------------------MGKLCLLKLELLPFLILIL
       M.domestica_TA28184       (1) ----------------------MAKRQK--HDELLLLVLSLSLLSFC
       M.truncatula_TA23636      (1) -----------------------MAENAS------TELKMFVLFCLLL
       V.vinifera_GSVIVT00025039001 (1) -------------------MGFLSNSSGFSDMLKKLLLLPLLLSFL
       A.thaliana_AT1G08450_CRT3 (1) ------------------------MGLPQNKLS---FFCFFFLVSVLTL
       B.napus_BPS_33882         (1) -----------------------MGLTQNKLKSFHLFLFLFLFSLLTL
       G.raimondii_TA11257       (1) -----------------------MGKLVPNRSFFLLFLFLFLHFLL
       P.trichocarpa_VII.148     (1) -------------------MEKKLRLHVVQALKLLFLLFTIHCLFL
       H.vulgare_TA32081         (1) --------------------MCSSRRRGDRQLQLLHRLLALSWL
       T.aestivum_TA53764        (1) --------------------MGSSRRRGDRHLKLLHRLLALSSL
       O.sativa_Os01g67054.1     (1) --------MLAALPSHRSSLVFSGEPPAMGSRSGGRHRLFLRFIALWSL
       Z.mays_TA15627            (1) ----------------------MGTGRRGGGGGGVFHRLLALSSL
       O.sativa_Os05g43170.1     (1) ------------------------MGRLRRGGVGLLRGAVVLASL
       S.bicolor_TA24664         (1) -----------------------MPMGRLRDG-RAFLHRALVLSSL
       Z.mays_BPS_22383          (1) -----------------------MGRLRDG-RAFLHRALVLSSL
       P.patens_164102           (1) ------------------------MAAPP--------ALFPALLLVLSV
       C.reinhardtii_TA11983     (1) ----------------------------------MKWGVVAVLATL
       P.pinaster_TA4383         (1) -----------------------MAGRR---------SLLYAVLLLLF
       P.taeda_TA5639            (1) -----------------------MAGRR---------TLLYAVFLLLF
       W.mirabilis_TA538         (1) -----------------------MAAGR---------SLSCATILLLF
       P.sitchensis_TA20930      (1) -----------------------MASGG---------LVKLGLLLICF
       B.distachyon_TA448        (1) -----------------------MPALAR-------SPSFAVLAVLAL
       O.sativa_Os03g0832200     (1) -----------------------MAIPRRS------AAAVAAVVALAS
       H.vulgare_TA38555         (1) -----------------------MAVLARS------AAAVVALALSLL
       T.aestivum_TA74192        (1) -----------------------MAVLARS------AAAVAALALALL
       S.bicolor_TA25211         (1) -----------------------MAILERSSSPAAASVAVAALIALAS
       H.vulgare_BPS_7785        (1) -----------------------MAIRRGSS--------CAVLALLALAS
       T.aestivum_TA50840        (1) --MGSDRIGVKASTSSRLDCRRPPEMAIRRGSS------CAVLALLALAS
       S.bicolor_TA20922         (1) -----------------------MAIRRGPS------YAVAALLALAS
       Z.mays_TA170881           (1) -----------------------MAIRKGSS------YAVAALLALAS
       O.sativa_Os07g0246200     (1) -----------------------MAIRARSSS--YAAAAVALALAS
       A.trichopoda_TA1102       (1) -----------------------MAGRS---------LLCLLSFLLL
       A.thaliana_AT1G09210_CRT2 (1) -----------------------MAKMI-PS---------LVSLILIGL
       B.napus_BPS_28478         (1) -----------------------MAKLI-LG---------LVSLILIGL
       A.thaliana_AT1G56340_CRT1 (1) -----------------------MAKLN-PK---------FISLILFAL
       B.napus_TA20659           (1) -----------------------MAKLN-PN---------FISLILIGL
       A.formosa_TA9419          (1) -----------------------MAIRR-KNP----SFLGFILLSVFL
       C.annuum_TA4292           (1) -----------------------MATQRRKSP----SSLYLIAVFSLL
       S.habrochaites_TA1435     (1) -----------------------MATRRMKRP----SSLHLVAVFSLL
       S.lycopersicum_TA36564    (1) -----------------------MATRRMKSP----SSLHLVAVFSLL
       S.tuberosum_TA24720       (1) -----------------------MATRRMKSP----SSLHLVAVFSLL
       G.hirsutum_TA20990        (1) ------------------MSTTMANHK-RFP-----NFVSLILLS-L
       G.raimondii_TA8857        (1) ------------------MSTTMANHK-RFP-----NFVSLILLS-L
       G.raimondii_TA8860        (1) -----------------------MAIPK-RNP-----IFLSVIFVS-L
       I.nil_TA5002              (1) -------------------MAALRR-LNS    VFLSLAKLYLL
       C.endivia_TA1106          (1) -----------------------MATQK-FS-------GIAFLSLLLL
       C.solstitialis_TA9        (1) -----------------------MAKLR-LNP----S-SLGLLSLLLL
       H.annuus_TA7525           (1) -----------------------MAIRR-LNP----K-SLSFLSLLLL
       H.argophyllus_TA1300      (1) -----------------------MAIRR-LNH----K-SLSFLSLLLL
       L.serriola_TA711          (1) -----------------------MANRR-LNP----T-SLAFLALLLL
       O.basilicum_TA646         (1) MNRRGLLLILISHQVIHYSAAMAIVQRRSL-ITT----L-LSVALTLSLL
       B.vulgaris_TA7257         (1) -----------------------MENRG-RNP----S-FLSLLLLLSL
       M.domestica_TA24948       (1) -----------------------MAFRV-RNS----S-SLLSLVLLSL
       P.persica_TA3474          (1) -----------------------MAFRV-PNS----S--LLSLILLSL
       G.max_BPS_38275           (1) -----------------------MAFRV-RSP----D--LRSLFLLSL
       P.vulgaris_TA3122         (1) ------------------MAMAMAFRV-RNP----D--LRSLILLSL
       L.japonicus_TA548         (1) -----------------------MALRV-R----------SLILLCL
       M.truncatula_AC149474     (1) -----------------------MAIRV-RNP----N--LLSLVLFSL
       P.trichocarpa_133.107     (1) -----------------------MGNPK-T------L--SLSLILFSL
       P.trichocarpa_729432      (1) -----------------------MANP---------K--IIPLILFSL
       R.communis_U74630         (1) -----------------------MANP---------K--SLSLFLLSL
       V.vinifera_TA38405        (1) -----------------------MAIRG-RNP----NPIFLSLALFSL
                      Consensus  (1)                         MA              L  LLLL L
```

FIGURE 4

```
                                              51                                                  100
            A.formosa_TA8804        (30)  FKYSVSEIIFEERFEDG-WQSRWVKSDWKKSEGKAGSFKHTAGKWSGDPE
            C.maculosa_TA223        (27)  CDFSYSEIIFEERFEDG-WQSRWVKSDWKRSEGKAGNFKHTAGSWSGDPD
          P.trifoliata_TA7309       (12)  FQISVSEIFFEERFDDG-WRSRWVISDWKRSEGKAGYFKHTAGKWHGDPD
             E.esula_TA10075        (20)  AQLSLAEIIFEERFDDG-WHSRWVKSDWKKSEGKAGTFKHTAGKWNGDPD
           M.domestica_TA28184      (24)  FRSSLSEIIFEERFDDDGWRSRWVKSDWKSSEGKAGSFKHTAGKWAGDHD
           M.truncatula_TA23636     (20)  IQVSLSEVIFEERFEDG-WRSRWVKSDWKSSEGKAGSFKHTAGKWAGDPD
    V.vinifera_GSVIVT00025039001    (28)  LTFSLSEVIFEERFEDG-WQSRWVKSDWKKSEGKAGSFKHTAGKWAGDPD
      A.thaliana_AT1G08450_CRT3     (23)  APLAFSEIFLEEHFEGG-WKSRWVLSDWKRNEGKAGTFKHTAGKWPGDPD
             B.napus_BPS_33882      (26)  TPLAFSEIFFEEHFEGG-WKSRWVLSDWKRNEGKAGTFKHTAGKWPGDPD
           G.raimondii_TA11257      (23)  FDFALSEIFFEERFEDG-WKSRWVLSDWKRSEGKAGTFKHTAGKWSGDPD
          P.trichocarpa_VII.148     (28)  FPVTLSEIFFEERFQDG-WKDRWVLSDWKRSEGKAGTFKYTAGKWPGDPD
             H.vulgare_TA32081      (25)  LLLASGEVIFEERFEDG-WETRRVKSDWKRSEGKAGTFKHTAGKYSGDPD
            T.aestivum_TA53764      (25)  LLLASGEVIFEERFEDG-WETRWVKSDWKKSEGKAGMFKHTAGKYSGDPD
          O.sativa_Os01g67054.1     (42)  LLIAAGEVIFEERFEDG-WESRWVKSDWKRSEGKAGTFKHTAGRYSGDPD
              Z.mays_TA15627        (24)  LLLASGEVVFEERFEDG-WETRWVESDWKRSEGKAGRFKHTAGRYSADPD
          O.sativa_Os05g43170.1     (22)  LLVVSGEVIFEERFDDD-WGSRWVKSDWKKSEGKAGTFKHTAGSYSGDPD
            S.bicolor_TA24664       (23)  LLLASGEIFFEERFDDG-WDSRWVKSDWKKSQGQTGTFRHTAGTYSGDPD
              Z.mays_BPS_22383      (21)  LLLASGEIFFEERFDDG-WDSRWVKSDWKKSQGQAGTFRHTAGTYSGDPD
             P.patens_164102        (18)  VCLAACEVIFQERFDDG-WESRWIQSNWKKSQGLNGNFVHTPGKWYGDEN
          C.reinhardtii_TA11983     (13)  VVAASAKDYFKETFDGS-WADRWTKSSWKVSDGSAGEFKLTAGKWYGDAE
            P.pinaster_TA4383       (17)  VTFVSAEVFFEERFDDS-WESRWVQSDWKKDESLAGDWVHTAGKWNGDPN
             P.taeda_TA5639         (17)  VTLVSAEVFFEERFDDS-WESRWVQSDWKKDESLAGDWVHTAGKWNGDPN
           W.mirabilis_TA538        (17)  ASIASAKVFFEERFEDG-WEKRWVHSDWKKDEKMAGEWVHTSGKWNGDPN
          P.sitchensis_TA20930      (17)  ASISSAHVYLDERFDDG-WENRWVISDWKKDEGAAGEWLHTAGKWNGDPD
           B.distachyon_TA448       (19)  ATAVAGEVFFQEKFDDG-WVDRWVKSEWKKEDNTAGEWNHTSGKWNGDAE
          O.sativa_Os03g0832200     (20)  VAAVAGEVFFQEKFDDG-WEDRWVKSEWKKDDNRAGEWNHTSGKWYGDAD
             H.vulgare_TA38555      (20)  VSAAAGEVFFQEKFDDG-WEDRWVKSEWKKEDNTAGEWNHTSGKWNGDAD
            T.aestivum_TA74192      (20)  VSAVAGEVFFQEKFDDG-WEDRWVKSEWKKEDNTAGEWNHTSGKWNGDAD
            S.bicolor_TA25211       (26)  VAGVAGEVFFQEKFEDG-WEDRWVKSDWKKDDNTAGEWNHTSGKWNGDAD
             H.vulgare_BPS_7785     (20)  VAAVAADVFFQEKFEDG-WESRWVKSEWKKDENMAGEWNHTSGKWHGDAE
            T.aestivum_TA50840      (43)  VAAVSADVFFQEKFEDG-WESRWVKSEWKKDENMAGEWNHTSGKWHGDAE
            S.bicolor_TA20922       (20)  VAAVAGEVFFQEKFEDG-WESRWVKSEWKKDENMAGEWNHTSGKWNGDAE
              Z.mays_TA170881       (20)  VAAVAGEVFFQEKFEDG-WESRWVKSEWKKDENMAGEWNHTSGKWNGDAE
          O.sativa_Os07g0246200     (24)  VAAVAGEVFFQEKFEDG-WESRWVKSEWKKDENMAGEWNHTSGKWNGDPE
           A.trichopoda_TA1102      (16)  IQNPLAKVLFEERFDDG-WEKRWVVSDWKKDENMSGQWIHTSGKWTGDPN
      A.thaliana_AT1G09210_CRT2     (17)  VAIASAAVIFEERFDDG-WENRWVKSEWKKDDNTAGEWKHTAGNWSGDAN
             B.napus_BPS_28478      (17)  VAIASAAVIFEERFDDG-WENRWVKSEWKKDDQSAGEWNHTSGNWSGDAN
      A.thaliana_AT1G56340_CRT1     (17)  VVIVSAEVIFEEKFEDG-WEKRWVKSDWKKDDNTAGEWKHTAGNWSGDAN
             B.napus_TA20659        (17)  VAIASASVIFEEKFEDG-WEKRWVKSDWKKDDNTAGEWSHTAGNWSGDAN
            A.formosa_TA9419        (21)  VGIVSAEVFFEERFEDG-WENRWVKSDWKKDENTAGEWNFTAGKWHGDAN
             C.annuum_TA4292        (22)  VASAAAKVFFEENFNDG-WESRWVKSDWKKDENMAGEWNHTSGKWSGDAN
         S.habrochaites_TA1435      (22)  VVAAAAEVFFQESFNDG-WESRWVKSEWKKDENMAGEWNHTSGKWNGDAN
         S.lycopersicum_TA36564     (22)  VVAAAAEVFFQESFNDG-WESRWVKSEWKKDENMAGEWNHTSGKWNGDAN
            S.tuberosum_TA24720     (22)  VVAAAAEVFFEESFNDG-WESRWVKSEWKKDENMAGEWNHTSGKWNGDAN
            G.hirsutum_TA20990      (23)  VATASAEVFFEERFEDG-WESRWVKSDWKKDENMAGEWNYTSGKWNGDLN
            G.raimondii_TA8857      (23)  VATASAEVFFEERFEDG-WESRWVKSDWKKDENMAGEWNYTSGKWNGDPN
            G.raimondii_TA8860      (19)  LAIASAKVFFEERFDEG-WESRWVKSDWKKDENMAGEWNYTSGKWNGDPN
               I.nil_TA5002         (21)  VAFVSAGVIFEERFDDG-WESRWVKSDWKKDENMAGEWNYTSGKWNGDPN
             C.endivia_TA1106       (18)  ISIASAKVFFEERFDDG-WESRWVKSDWKKEDNMAGEWNYTSGKWNGDAE
          C.solstitialis_TA9        (20)  LSVASAKVFFEERFEDG-WESRWVKSDWKKEENTAGEWNYTSGQWTGDAN
             H.annuus_TA7525        (20)  FSIASAKVFFEERFEDG-WENKWVKSDWKKDENMAGEWNYTSGKWNGDAN
          H.argophyllus_TA1300      (20)  FSIASAKVFFEERFEDG-WENKWVKSDWKKDENMAGEWNYTSGKWNGDAN
             L.serriola_TA711       (20)  FSIASAKVFFEERFDDG-WESRWVKSDWKKDENMAGEWNYTSGKWNGDAN
           O.basilicum_TA646        (45)  LAVASAAVFFEERFDDG-WESRWVKSDWKKDENMAGEWNYTSGKWNGNPD
            B.vulgaris_TA7257       (20)  FAIASAKVFFEERFEDG-WEKRWVKSEWKKDESMAGEWNYTSGKWNGDAN
           M.domestica_TA24948      (20)  LAIASAKVFFEERFEDG-WDKRWVKSDWKREEGLAGEWNYTSGKWNGDAN
             P.persica_TA3474       (19)  LAIASAKVFFEERFEDG-WDKRWVTSEWKKEENLAGEWNYTSGKWNGDPN
             G.max_BPS_38275        (19)  LSIASANVFFEERFDDG-WENRWVKSDWKKDENVAGEWNHTSGQWNGDAN
            P.vulgaris_TA3122       (23)  LTIASAKVFFEERFEDG-WENRWVKSDWKKDENLAGQWNHTSGQWNGNAN
            L.japonicus_TA548       (14)  FAIASAKVFFEERFDDG-WENRWVKSEWKKDESLAGEWNYTSGQWNGDAN
          M.truncatula_AC149474     (19)  LSIASAKVFFEERFQDG-WESRWVKSEWKKDENLAGEWNYTSGQWNGDAN
          P.trichocarpa_I33.107     (17)  FAITSAKVFFEERFEDG-WENRWVVSDWKKDENTAGVWNHTSGKWNGDAN
          P.trichocarpa_729432      (15)  FAIASAKVFFEERFEDG-WENSWVVSDWKKDENTAGEWNYTSGKWNGDPN
            R.communis_U74630       (15)  LAIASAEVFFEERFEDG-WENRWVKSDWKKDENTAGEWNYTSGKWNGDPN
            V.vinifera_TA38405      (21)  LSIASAKVFFEERFHDG-WENKWVKSEWKKDENMAGEWNYTSGKWHGDPN
                       Consensus    (51)  VAIASAEVFFEERFEDG WESRWVKSDWKKDEN AGEWNHTSGKWNGD N
```

FIGURE 4 (continued)

```
                                              101                                          150
              A.formosa_TA8804       (79)  -DKGIQTYPDAKHFAISAKI-PEFSNKDRTLVVQYSIKMEQDIECGGGYI
             C.maculosa_TA223        (76)  -DKGIQTTTDARHFAISAKI-PEFNNKNRTLVLQYSIKIEQDIECGGGYI
            P.trifoliata_TA7309      (61)  -DKGIQTHTDARHYAISAKI-PEFSNKNRTLVVQYSIRFEQDIECGGGYL
                E.esula_TA10075      (69)  -DKGIQTAGDAKHFAVSAKI-PEFTNKNRTLVLQYSIRFEQDIECGGGYI
            M.domestica_TA28184      (74)  -DRGIQTSNDAKHFAISAKI-PEFSNKNRTLVLQYSIKFEQEIECGGGYI
           M.truncatula_TA23636      (69)  -DKGIQTSNDAKHFAISAKI-PEFSNKNRTLVFQYSIKFEQEIECGGGYM
     V.vinifera_GSVIVT00025039001    (77)  -DKGIQTSTDARHFAISAKI-PEFSNKNRTLVLQYSIRFEQEIECGGGYI
         A.thaliana_AT1G08450_CRT3   (72)  -NKGIQTYNDAKHYAISAKI-PEFSNKNRTLVVQYSVKIEQDIECGGAYI
              B.napus_BPS_33882      (75)  -NKGIQTYNDAKHYAISAKI-QEFSNKNRTLVVQYSVKIEQDIECGGAYI
            G.raimondii_TA11257      (72)  -DKGIQTYNDAKHYAISAKI-PEFSNKNRTLVVQYSIKIEQDIECGGGYI
          P.trichocarpa_VII.148      (77)  -DKGIQTYNDAKHFAISAKISPEFSNKNRTLVVQYSIKFEQEIECGGGYI
              H.vulgare_TA32081      (74)  -DKGIQTTIDARHFAISAKI-PEFSNKGRTLVVQYSIKFEQEIECGGGYI
             T.aestivum_TA53764      (74)  -DKGIQTTIDARHFAISAKI-PEFSNKGRTLVVQYSIKFEQEIECGGGYI
         O.sativa_Os01g67054.1       (91)  -DKGIQTTLDARHFAISAKI-PEFSNKGRTLVLQYSIKFEQDIECGGGYI
                Z.mays_TA15627       (73)  -DKGIQTTIDARHFAISAKF-PEFSNKNRTLVVQYSIKFEQDIECGGGYI
         O.sativa_Os05g43170.1       (71)  -DRGIQTTSDAKHFAISAKF-PEFSNKNRTLVVQYSIKIEQDIECGGAYI
              S.bicolor_TA24664      (72)  -DKGIQTTGDAKHFAISAKF-PEFSNKDRTLVIQYSLKIEQDIECGGAYI
              Z.mays_BPS_22383       (70)  -DKGIQTTGDAKHFAISAKF-PQFSNKDRTLVIQYSLKIEQDIECGGAYI
              P.patens_164102        (67)  -DKGIQTSTDSRYYAISAQIP-EFNNKGKTLVLQYQVKHEQNIECGGGYV
           C.reinhardtii_TA11983     (62)  ADKGIQTGPDSKFFAISAPLATVFDNTGKDTVVQFSVKHEQDLDCGGGYV
              P.pinaster_TA4383      (66)  -DKGIQTHTDYRFFAISAAYP-EFSNKDKTLVLQFSVKHEQKLDCGGGYV
               P.taeda_TA5639        (66)  -DKGIQTHTDYRFFAISAAYP-EFSNKDKTLVLQFSVKHEQKLDCGGGYV
             W.mirabilis_TA538       (66)  -NKGIQTQTDYRFFAISAEFP-EFSNKDKTLVLQFSVKHEQKLDCGGGYV
            P.sitchensis_TA20930     (66)  -DKGIQTHPDARFFAISAEFP-EFNNKDKTLVLQFSVKHEQKLDCGGGYV
             B.distachyon_TA448      (68)  -DKGIQTSEDYRFYAISAQFP-ELSNKDKTLVLQFSVKHEQKLDCGGGYV
         O.sativa_Os03g0832200       (69)  -DKGIQTSEDYRFYAISAKYP-EFSSKDKTLVLQFSVKHEQKLDCGGGYV
              H.vulgare_TA38555      (69)  -DKGIQTSEDYRFYAISAQYP-EFSSKDKTLVLQFSVKHEQDLDCGGGYV
             T.aestivum_TA74192      (69)  -DKGIQTSEDYRFYAISAQYP-ELRNKDKTLVLQFSVKHEQDLDCGGGYI
              S.bicolor_TA25211      (75)  -DKGIQTSEDYRFYAISAQYP-EFSNKDKTLVLQFSVKHEQKLDCGGGYL
              H.vulgare_BPS_7785     (69)  -DKGIQTSEDYRFYAISAEYP-EFSNKDKTLVLQFTVKHEQKLDCGGGYV
             T.aestivum_TA50840      (92)  -DKGIQTSEDYRFYAISAEYP-EFSNKDKTLVLQFTVKHEQKLDCGGGYV
              S.bicolor_TA20922      (69)  -DKGIQTSEDYRFYAISAEYP-EFSSKDKTLVLQFSVKHEQKLDCGGGYV
               Z.mays_TA170881       (69)  -DKGIQTSEDYRFYAISAEYP-EFSNKDKTLVLQFSVKHEQKLDCGGGYV
           O.sativa_Os07g0246200     (73)  -DKGIQTSEDYRFYAISAEYP-EFSNKDKTLVLQFSVKHEQKLDCGGGYV
             A.trichopoda_TA1102     (65)  -DKGIQTSEDYRFFAISAEFP-VFSNKDKTLVFQFSVKHEQKLDCGGGYM
         A.thaliana_AT1G09210_CRT2   (66)  -DKGIQTSEDYRFYAISAEFP-EFSNKDKTLVFQFSVKHEQKLDCGGGYM
              B.napus_BPS_28478      (66)  -DKGIQTSEDYRFYAISAEFP-EFSNKDKTLVFQFSVKHEQKLDCGGGYM
         A.thaliana_AT1G56340_CRT1   (66)  -DKGIQTSEDYRFYAISAEFP-EFSNKDKTLVFQFSVKHEQKLDCGGGYM
              B.napus_TA20659        (66)  -DKGIQTSEDYRFYAISAEFP-EFSNKDKTLVFQFSVKHEQKLDCGGGYM
              A.formosa_TA9419       (70)  -DKGIQTSEDYRFYAISAGFP-EFSNKEKTLVFQFSVKHEQKLDCGGGYM
              C.annuum_TA4292        (71)  -DKGIQTSEDYRFYAISAEFP-EFSNKGKNLVFQFSVKHEQKLDCGGGYM
          S.habrochaites_TA1435      (71)  -DKGIQTSEDYRFYAISAEFP-EFSNKGKNLVFQFSVKHEQKLDCGGGYM
           S.lycopersicum_TA36564    (71)  -DKGIQTSEDYRFYAISAEFP-EFSNKGKNLVFQFSVKHEQKLDCGGGYM
             S.tuberosum_TA24720     (71)  -DKGIQTSEDFRFYAISAEFP-EFSNKGKNLVFQFSVKHEQKLDCGGGYM
             G.hirsutum_TA20990      (72)  -DKGIQTSEDYRFYAISAEFP-EVNNKGKTLVFQFSVKHEQKLDCGGGYM
            G.raimondii_TA8857       (72)  -DKGIQTSEDYRFYAISAEFP-EVNNKGKTLVFQFSVKHEQKLDCGGGYM
            G.raimondii_TA8860       (68)  -DKGIQTSEDYRFYAISAEFP-EVNNKDKTLVFQFSVKHEQKLDCGGGYM
                I.nil_TA5002         (70)  -DKGIQTSEDYRFYAISAEFP-EFNNKGKTLVFQFSVKHEQKLDCGGGYM
              C.endivia_TA1106       (67)  -DKGIQTSEDYRFYAISAEYP-EFSNKDKTLVFQFSVKHEQKLDCGGGYM
           C.solstitialis_TA9        (69)  -DKGIQTSEDYRFYAISAEYP-EFSNKDKTLVFQFSVKHEQKLDCGGGYM
              H.annuus_TA7525        (69)  -DKGIQTSEDYRFYAISAEYP-EFSNKDKTLVFQFSVKHEQKLDCGGGYM
           H.argophyllus_TA1300      (69)  -DKGIQTSEDYRFYAISAEYP-EFSNKDKTLVFQFSVKHEQKLDCGGGYM
              L.serriola_TA711       (69)  -DKGIQTSEDYRFYAISAEYP-EFSNKDKTLVFQFSVKHEQKLDCGGGYM
             O.basilicum_TA646       (94)  -DKGIQTSEDYRFYAISAEFP-EFSNKDKTLVFQFSVKHEQKLDCGGGYM
              B.vulgaris_TA7257      (69)  -DKGIQTSEDYRFYAISAEFP-EFSNKDNTLVFQFSVKHEQKLDCGGGYM
             M.domestica_TA24948     (69)  -DKGIQTSEDYRFYAISAEFP-EFSNKDKTLVFQFSVKHEQKLDCGGGYI
              P.persica_TA3474       (68)  -DKGIQTSEDYRFYAISAEFP-EFSNKDKTLVFQFSVKHEQKLDCGGGYI
               G.max_BPS_38275       (68)  -DKGIQTSEDYRFYAISAEYP-EFSNKGKTLVFQFSVKHEQKLDCGGGYM
              P.vulgaris_TA3122      (72)  -DKGIQTSEDYRFYAISAEYP -EFSNKDNTLVFQFSVKHEQKLDCGGGYM
              L.japonicus_TA548      (63)  -DKGIQTSEDYRFYAISAEFP-EFSNKDNTLVFQFSVKHEQKLDCGGGYM
           M.truncatula_AC149474     (68)  -DKGIQTSEDYRFYAISAEFP-EFSNKDNTLVFQFSVKHEQKLDCGGGYM
           P.trichocarpa_133.107     (66)  -DKGIQTSEDYRFYAISAEFP-ELSNKDQTLVFQFSVKHEQKLDCGGGYL
            P.trichocarpa_729432     (64)  -DKGIQTSEDYRFYAISAEFP-KFSNKDQTLVFQFSVKHEQKLDCGGGYM
             R.communis_U74630       (64)  -DKGIQTSEDYRFYAISAEFP-EFSNKDKTLVFQFSVKHEQKLDCGGGYM
              V.vinifera_TA38405     (70)  -DKGIQTSEDYRFYAISAEYP-EFSNKDKTLVFQFTVKHEQKLDCGGGYM
                    Consensus       (101)   DKGIQTSEDYRFYAISAEFP EFSNKDKTLVLQFSVKHEQKLDCGGGYM
```

FIGURE 4 (continued)

```
                                        151                                                    200
         A.formosa_TA8804          (127) KLLSGYVN--QKKFGGDTPYSMMFGPDLCGSQTKKLHAILSYQGQNYPIK
         C.maculosa_TA223          (124) KLMSGYVN--QKKFGGDTPYSVMFGPDLCGTQTKKLHVILSYQGQNYPIK
         P.trifoliata_TA7309       (109) KLLSAYVN--QKKFGGDAPYSLMFGPDICGTQKKHLHVILSYQGQNYPIK
         E.esula_TA10075           (117) KLLSGFVN--QKKFGGDTPYSLMFGPDICGTQTKKLHVILSYQGQNYPIK
         M.domestica_TA28184       (122) KLMSGFVN--QKKFGGDTPYSLMFGPDICGTDTKKLHVILSYQGQNYPIK
         M.truncatula_TA23636      (117) KLLSGFVN--QKKFGGDTPYSVMFGPDLCGTDTKKLHVIVSYQGQNYPVK
 V.vinifera_GSVIVT00025039001      (125) KLLSGFVN--QKKFGGDTPYSVMFGPDLCGTQTKKLHVIVSYQGQNYPIK
       A.thaliana_AT1G08450_CRT3   (120) KLLSGYVN--QKQFGGDTPYSIMFGPDICGTQTKKLHVIVSYQGQNYPIK
            B.napus_BPS_33882      (123) KLLSGYVN--QKQFGGDTPYSLMFGPDICGTQTKKLHVILSYQGQNYPIK
         G.raimondii_TA11257       (120) KLLSGYVN--QKKFGGDTPYSFMFGPDICGTQTKKLHVILSYQGQNYPIR
         P.trichocarpa_VII.148     (126) KLFSGYVN--QKKFGGDTPYSFMFGPDICGTQTKKLHVIMSYQGQNYPIK
            H.vulgare_TA32081      (122) KLMSGYVN--QKKYSGDTPYSLMFGPDICGTQTKKLHLILSYQGQNYPIK
            T.aestivum_TA53764     (122) KLMSGYVN--QKKFSGDTPYSLMFGPDICGTQTKKLHLILSYQGQNYPIK
         O.sativa_Os01g67054.1     (139) KLMSGYVN--QKKFSGDTPYSLMFGPDICGTQTKKLHLILSYQGQNYPIK
            Z.mays_TA15627         (121) KLMSGYVN--QKKFSGDTPYSLMFGPDICGTQTKKLHLILSYQGQNYPIK
         O.sativa_Os05g43170.1     (119) KLMSGYVN--QKKFGGDTPYSFMFGPDICGDQTKKLHLILSYQGQNYPIK
            S.bicolor_TA24664      (120) KLMSGYLN--QKKFGGDTPYSFMFGPDICGDQKKKLHLILSYQGQNYPIK
            Z.mays_BPS_22383       (118) KLMSGYLN--QKKFGGDTPYSFMFGPDICGDQKKKLHLILSYQGQNYPIK
            P.patens_164102        (115) KLMSGQVD--QKTFGGDTPYSIMFGPDICGSQTKKIHAILYKSKNHQMK
         C.reinhardtii_TA11983     (112) KVVPATSEKQMGEFGGDTPYSIMFGPDICGYSTRKVHVILTYKGKNYLIK
            P.pinaster_TA4383      (114) KLLSGEVD--QKNFSGETPYSIMFGPDICGYSTKKVHTILSYKGKNHPIK
            P.taeda_TA5639         (114) KLLSGEID--QKNFSGETPYSIMFGPDICGYSTKKVHTILSYKGKNHPIK
            W.mirabilis_TA538      (114) KLISGEMD--QKNFSGETPYSIMFGPDICGYATKKVHAILTYKGKNHLIK
         P.sitchensis_TA20930      (114) KLLSGDVD--QKKFGGDTPYSIMFGPDICGYSTKKVHAILGHGGKNLPIK
            B.distachyon_TA448     (116) KLLGADID--QKKFGGETPYSIMFGPDICGYATKKVHAILTKNGKNHLIK
         O.sativa_Os03g0832200     (117) KLLGGDVD--QKKFGGDTPYSIMFGPDICGYATKKVHAILTKNGKNHLIK
            H.vulgare_TA38555      (117) KLLPADVD--QNKFGGETPYSIMFGPDICGYATKKVHAILTKNGKNNLIK
            T.aestivum_TA74192     (117) KLLPADVD--QKKFGGETPYSIMFGPDICGYATKKVHAILTKNGKNHLIK
            S.bicolor_TA25211      (123) KLLGSDVD--QKKFGGDTPYSIMFGPDICGYATKKVHAILTKNGKNHLIK
            H.vulgare_BPS_7785     (117) KLLGGDVD--QKKFGGDTPYGIMFGPDICGYSTKKVHTILTKNGKNHLIK
            T.aestivum_TA50840     (140) KLLGGDVD--QKKFGGDTPYSIMFGPDICGYSTKKVHTILTKDGKNHLIK
            S.bicolor_TA20922      (117) KLLGGDVD--QKKFGGDTPYSIMFGPDICGYSTKKVHTILTKDGKNHLIK
            Z.mays_TA170881        (117) KLLGGDVD--QKKFGGDTSYSIMFGPDICGYSTKKVHTILTKDGKNHLIK
         O.sativa_Os07g0246200     (121) KLLGGDVD--QKKFGGDTPYSIMFGPDICGYSTKKVHTIFTKNDKNHLIK
            A.trichopoda_TA1102    (113) KLLSDDVD--QKKFGGDTPYSIMFGPDICGYSTKKVHAILSRNGTNHLIK
       A.thaliana_AT1G09210_CRT2   (114) KLLSGDVD--QKKFGGDTPYSIMFGPDICGYSTKKVHAILTYNEANHLIK
            B.napus_BPS_28478      (114) KLLSGDVD--QKKFGGDTPYSIMFGPDICGYSTKKVHAILTYNDANHLIK
       A.thaliana_AT1G56340_CRT1   (114) KLLSDDVD--QTKFGGDTPYSIMFGPDICGYSTKKVHAILTYNGTNHLIK
            B.napus_TA20659        (114) KLLSGDVD--QKKFGGDTPYSIMFGPDICGYDTKKVHAILTYNGTNHLIK
            A.formosa_TA9419       (118) KLLSGDVD--QKKFGGDTPYSIMFGPDICGYSTKKVHAILSRDGTNHLIK
            C.annuum_TA4292        (119) KLISGDVD--QKKFGGDTPYSIMFGPDICGYSTKKVHAILTYNDTNHLIK
         S.habrochaites_TA1435     (119) KLLSGDVD--QKKFGGDTPYSIMFGPDICGYSTKKVHAILTYNETNHLIK
         S.lycopersicum_TA36564    (119) KLLSGDVD--QKKFGGDTPYSIMFGPDICGYSTKKVHAILTYNETNHLIK
            S.tuberosum_TA24720    (119) KLLSGDVD--QKKFGGDTPYSIMFGPDICGYSTKKVHAILTHNETNHLIK
            G.hirsutum_TA20990     (120) KLLSGDVD--QKKFGGDTPYSIMFGPDICGYSTKKVHAILTYNGTNYLIK
            G.raimondii_TA8857     (120) KLLSGDVD--QKKFGGDTPYSIMFGPDICGYSTKKVHAILTYNGTNHLIK
            G.raimondii_TA8860     (116) KLLSGDID--QKKFGGETPYSIMFGPDICGYSTKKVHAILTYNGTNHLIK
            I.nil_TA5002           (118) KLLSGDID--QKKFGGDTPYSIMFGPDICGYSTKVHAILTYNGTNQLIK
            C.endivia_TA1106       (115) KLMSGDVD--QKKFGGDTPYSIMFGPDICGYATKKVHAILTYNGENKLIK
            C.solstitialis_TA9     (117) KLLSGDVD--QKKFGGDTPYSIMFGPDICGYATKKVHAILTYNGENKLIK
            H.annuus_TA7525        (117) KLLSGDVD--QKKFGGDTPYSIMFGPDICGYATKKVHAILTYNGENKLIK
         H.argophyllus_TA1300      (117) KLLSGDVD--QKKFGGDTPYSIMFGPDICGYATKKVHAILTYNGENKLIK
            L.serriola_TA711       (117) KLLSGDVD--QKKFGGDTPYSIMFGPDICGYATKKVHAILTYNGENKLIK
            O.basilicum_TA646      (142) KLLSGDID--QKKFGGDTPYSIMFGPDICGYTTKKVHAILTYNGTNNLIK
            B.vulgaris_TA7257      (117) KLLSGEVD--QKKFGGDTPYSIMFGPDICGYSTKKVHAIFNYNDTNHLIK
            M.domestica_TA24948    (117) KLLSGDVD--QKKFGGDTPYSIMFGPDICGYTTKKVHAILNYNDTNKLIK
            P.persica_TA3474       (116) KLLSGDVD--QKKFGGDTPYSIMFGPDICGYSTKKVHAILNYNNTNNLIK
            G.max_BPS_38275        (116) KLLSGDVD--QKKFGGDTPYSIMFGPDICGYSTKKVHAILTYNDTNHLIK
            P.vulgaris_TA3122      (120) KLLSGSVD--QKKFGGDTPYSIMFGPDICGYSTKKVHAILTYNDTNHLIK
            L.japonicus_TA548      (111) KLLSDDVD--QKKFGGDTPYSIMFGPDICGYTTKKVHAILTYNGTNHLIK
         M.truncatula_AC149474     (116) KLLSGDVD--QKNFGGDTPYSIMFGPDICGYSTKKVHAILTYNDTNHLIK
         P.trichocarpa_133.107     (114) KLLSGEVD--QKKFGGDTPYSIMFGPDICGHSTKKVHAILNYNQLIK
         P.trichocarpa_729432      (112) KLLSGEVD--QKKFGGDTPYSIMFGPDICGYSTKKVHAILNYNEANHLIK
            R.communis_U74630      (112) KLLSSSTD--QKKFGGDTPYSIMFGPDICGYSTKKVHAILNYNDTNHLIK
            V.vinifera_TA38405     (118) KLLSGEVD--QKKFGGDTPYSIMFGPDICGYTTKKVHAILTRDGKNHLIK
                     Consensus    (151) KLLSGDVD  QKKFGGDTPYSIMFGPDICGY STKKVHAI LTYNG NHLIK
```

FIGURE 4 (continued)

```
                                              201                                               250
         A.formosa_TA8804        (175) KDLQCETDKMTHFYTFILRPDASYSIWVDGRERESGSMYTDWDILPPRKI
         C.maculosa_TA223        (172) KDLQCETDKLTHFYTFILRPDASYSILIDGRERDSGSMYTDWDILPPRKI
       P.trifoliata_TA7309       (157) KELECETDKLTHFYTFILRPDASYSILIDNRERDSGSMYTDWDILPPRKI
           E.esula_TA10075       (165) KELECETDKLTHFYTFILRPDASYSILIDGRERDSGSMYTDWDILPPRKL
         M.domestica_TA28184     (170) KALECETDKLTHFYTFILRPDATYSVLIDNREKDSGSMYTDWDILPPRKI
        M.truncatula_TA23636     (165) KDLQCETDKLTHFYTFILRPDATYSVLVDNRERDSGSLYTDWDILPPRKI
V.vinifera_GSVIVT00025039001     (173) KDLQCETDKLTHFYTFILRPDASYSVLIDNRERESGSMYSDWDILPPRKI
     A.thaliana_AT1G08450_CRT3   (168) KDLQCETDKLNHFYTFILRPDASYSVLVDNKEREFGSMYTDWDILPPRKI
          B.napus_BPS_33882      (171) KDLQCETDKLTHFYTFILRPDASYSVLVDNKEREFGSMYTDWDILPPRKI
        G.raimondii_TA11257      (168) KDLQCETDKLTHFYTFILRPDASYSVLVDNRERETGSMYTDWDILPPRKI
       P.trichocarpa_VII.148     (174) KDLQCETDKLTHFYTFILRPDASYSVLVDNRERESGTMYTDWDILPPPKI
          H.vulgare_TA32081      (170) KDLQCETDRLTHVYTFILRPDASYSLLVDNRERESGSMYTDWDILPPRKI
         T.aestivum_TA53764      (170) KDLQCETDRLTHVYTFILRPDASYSLLVDNRERESGSMYTDWDILPPRKI
       O.sativa_Os01g67054.1     (187) KDLQCETDKLTHVYTFILRPDASYSILVDNRERESGSMYTDWDILPPRKI
           Z.mays_TA15627        (169) KDLECETDKLTHVYTFILRPDASYSILVDNRERESGSMYTDWDILPPRKI
       O.sativa_Os05g43170.1     (167) KDLKCETDKLTHFYTFILRPDASYSLLVDNREREFGSMYTDWDILPPRKI
          S.bicolor_TA24664      (168) KDLKCEADKLTHFYTFILRPDATYSILIDNREREFGSMYTDWDILPPRKI
          Z.mays_BPS_22383       (166) KELKCETDKLTHFYTFILRPDATYSILIDNREREFGSMYTDWDILPPRKI
           P.patens_164102       (163) KTVECETDKLSHVYTFIIRPDATYSILVDNKEKESGSLYKDWDLLPPRKI
       C.reinhardtii_TA11983     (162) KDIKAETDQLTHVYTFLVIKPDNTYQVLIDLKEVASGSLYEDWDMLPPKTI
         P.pinaster_TA4383       (162) KDVPCETDQLTHVYTFILRPDATYSILIDNKDKQSGSLYKDWDLLPSKTI
           P.taeda_TA5639        (162) KDVPCETDQLTHVYTFILRPDATYSILIDNTDKQSGSLYKDWDLLPPKTI
         W.mirabilis_TA538       (162) KEVPCETDQLTHVYTFILRPDATYSILIDNAEKQSGSLYKDWDLLPPKQI
        P.sitchensis_TA20930     (162) KDVSCETDQLTHVYTFILHPDATYSILIDNKEKDSGSLYTDWDILPPKQI
        B.distachyon_TA448       (164) KEVPCETDQLTHVYTLIIRPDATYSILIDNAEKQTGSIYDDWDILPAKKI
       O.sativa_Os03g0832200     (165) KDVPCKTDQLTHVYTLIIRPDAKYSILIDNTEKQTGSIYDDWNIIPPKNK
          H.vulgare_TA38555      (165) KEVPCETDQLTHVYTLIIRPDATYSILIDNVEKQSGSVYDDWDILPAKKK
         T.aestivum_TA74192      (165) KEVPCETDQLTHVYTLIIRPDATYSILIDNVEKQSGSVYDDWDILPAKKK
          S.bicolor_TA25211      (171) KEVPCETDQLTHVYTLIIRPDATYSILIDNDEKQSGSIYDDWDILPPKKI
         H.vulgare_BPS_7785      (165) KDVPCETDQLSHVYTLIIRPDATYSILIDNEEKQTGSIYEHWDILPPKEI
         T.aestivum_TA50840      (188) KDVPCETDQLSHVYTLIIRPDATYSILIDNEEKQTGSIYEHWDILPPKEI
          S.bicolor_TA20922      (165) KDVPCETDQLTHVYTLIIRPDATYSILIDNEEKQTGSIYEHWDILPPKQI
           Z.mays_TA170881       (165) KDVPCETDQLTHVYTLIIRPDATYSILIDNEEKQTGSIYEHWDILPPKKI
       O.sativa_Os07g0246200     (169) KDVPCETDQLSHVYTLIIHPDATYTILIDNVEKQSGSIYEHWDILPPKQI
        A.trichopoda_TA1102      (161) KEVPCETDQLTHAYTFIIRPDATYSILIDNNEKQTGSLYSDWDILPPKKI
     A.thaliana_AT1G09210_CRT2   (162) KDVPCETDQLTHVYTFILRPDATYSILIDNVEKQTGSLYSDWDLLPPKKI
          B.napus_BPS_28478      (162) KDVPCETDQLTHVYTFILRPDATYSILIDNVEKQTGSLYSDWDLLPPKKI
     A.thaliana_AT1G56340_CRT1   (162) KEVPCETDQLTHVYTFVLRPDATYSILIDNVEKQTGSLYSDWDLLPAKKI
          B.napus_TA20659        (162) KEVPCETDQLTHVYTFILRPDATYSILIDNVEKQTGSLYSDWDLLPAKKI
         A.formosa_TA9419        (166) KDVPCETDQLTHVYTFVLRPDASYSILIDNVEKQSGSLYSDWDILPPKKI
          C.annuum_TA4292        (167) KEVPCETDQLTHVYTFILRPDATYSILIDSVEKQSGSLYSDWDILPPKTI
      S.habrochaites_TA1435      (167) KDVPCETDQLTHVYTFILRPDATYSILIDNVEKQSGSLYSDWDILPPKKI
       S.lycopersicum_TA36564    (167) KDVPCETDQLTHVYTFILRPDATYSILIDNVEKQSGSLYSDWDILPPKKI
        S.tuberosum_TA24720      (167) KDVPCETDQLTHVYTFILRPDATYSILIDNVEKQSGSLYSDWDILPPKKI
         G.hirsutum_TA20990      (168) KEVPCETDQLTHVYTFILRPDATYSILIDNVEKQTGSLYTDWDLLPPKKI
        G.raimondii_TA8857       (168) KEVPCETDQLTHVYTFILRPDATYSILIDNVEKQTGSLYTDWDLLPPKKI
        G.raimondii_TA8860       (164) KEVPCETDQLTHVYTFILRPDATYSILVDNVEKQSGSLYTDWDLLPPKKI
            I.nil_TA5002         (166) KDVPCETDQLTHVYTFILRPDATYSILIDNEEKQSGSLYTDWNLLPPKKI
          C.endivia_TA1106       (163) KDVPCETDQLTHVYTFILRPDATYSILIDNEEKQTGSLYKDWDLLPPKQI
        C.solstitialis_TA9       (165) KDVPCETDQLTHVYTFILRPDATYSILIDNVEKQTGSLYSDWDLLPAKQI
          H.annuus_TA7525        (165) KDVPCETDQLSHVYTFVLRPDATYSILIDNVEKQTGSLYSDWDLLPPKQI
       H.argophyllus_TA1300      (165) KDVPCETDQLSHVYTFILRPDATYSILIDNVEKQTGSLYSDWDLLPPKQI
         L.serriola_TA711        (165) KDVPCETDQLSHVYTFVLRPDATYTISIDNVEKQTGSLYSDWDLLPAKQI
         O.basilicum_TA646       (190) KDVPCETDQLTHVYTFILKPDATYTILIDNVEKQSGSLYSDWDLLPPKQI
          B.vulgaris_TA7257      (165) KDVPCETDQLTHVYTFILRPDATYSILIDNQEKQTGSLYTDWDLLPAKKI
         M.domestica_TA24948     (165) KDVPCETDQLTHVYTFILRPDATYSILIDNVEKQTGSLYSDWDLLPPKKI
          P.persica_TA3474       (164) KDVPCETDQLTHVYTFIIRPDATYTILIDNAEKQTGSLYSDWDLLPAKKI
          G.max_BPS_38275        (164) KDVPCETDQLTHVYTFILRPDATYSILIDNVEKQTGSLYSDWDLLPPKTI
         P.vulgaris_TA3122       (168) KDVPCETDQLTHVYTFILRPDATYTILIDNVEKQSGSLYTDWDLLPPKKI
         L.japonicus_TA548       (159) KDVPCETDQLTHVYTFILRPDATYSILIDNVEKQTGSLYSDWSLLPPKKI
        M.truncatula_AC149474    (164) KDVPCETDQLTHVYTFIIRPDATYSILIDNVEKQTGSLYSDWSLLPPKKI
       P.trichocarpa_133.107     (162) KEVPCETDQLSHVYTFIIRPDATYSILIDNVEKQTGSLYTDWDLLPPKQI
       P.trichocarpa_729432      (160) KEVPCETDQLTHVYTLIIRPDATYSILIDNVEKQTGSLYSDWDLLPPKTI
         R.communis_U74630       (160) KEVPCETDQLTHVYTLVIRPDATYSILIDNVEKQTGSLYTDWDLLPPKKI
         V.vinifera_TA38405      (166) KDVPCETDQLSHVYTFILKPDATYSILIDNVEKQTGSLYSDWDILPPKKI
              Consensus         (201) KDVPCETDQLTHVYTFILRPDATYSILIDN EKQSGSLYTDWDILPPKKI
```

FIGURE 4 (continued)

```
                                              251                                                300
             A.formosa_TA8804    (225)  KAVNAKKPLDWEDREYIDDPNDIKPEGYDSIPAEIPDPKAKEPDSWDEEE
             C.maculosa_TA223    (222)  KDVKAKKPADWEEREYIEDPDQVKPEGYDSIPREIPDPKAKQPDTWDEDE
           P.trifoliata_TA7309   (207)  KAVNAKKPADWDDREYIDDPNAVKPEGYDSIPKEIPDPKAKKPDNWDEDE
               E.esula_TA10075   (215)  RDTKAKKPKDWDDREYIDDPNAVKPQGYDKIPKEIPDHSAKEPIDWDDEV
          M.domestica_TA28184    (220)  KDVTAKKPADWDLREYIDDPNHIKPEGYDSIPREIPDPKAKEPEDWDDEE
          M.truncatula_TA23636   (215)  KDLKAKKPADWEDREYIEDPNAVKPEGYDSIPAEIPDPKAKEPDSWDEDE
       V.vinifera_GSVIVT00025039001 (223) KDTKAKKPADWDDREYIEDPNDVKPEGYDSIPAEIPDPKAKEPDNWDEEE
       A.thaliana_AT1G08450_CRT3 (218)  KVKNAKKPEDWDDREYIDDPNDVKPEGFDSIPREIPDRKAKEPEDWDEEE
                B.napus_BPS_33882 (221)  KVKNAKKPVDWDDREYIDDPDDVKPEGYDSIPREIRDQKAEEPEDWDEEE
            G.raimondii_TA11257  (218)  KDVKAKKPADWDDREYIEDPNDVKPEGYDKIPAQIPDPKAKEPDDWDDEE
          P.trichocarpa_VII.148  (224)  KDTKAKRPADWDDREYIEDPNDVKPEGYDSIPREIPDPKAKEPDNWDEEE
              H.vulgare_TA32081  (220)  KDVGAKKPKDWDDREYIEDPDAVKPEGYDSIPREIPDPKDKKPDTWDDDD
             T.aestivum_TA53764  (220)  KDVGAKKPKDWDDREYIEDPDAVKPEGYDSIPREIPDPKDKKPDTWDDDD
          O.sativa_Os01g67054.1  (237)  KDVHAKKPKDWDDREYIEDPDAVKPEGYDSIPKEIPDPKDKKPDTWDDDD
                 Z.mays_TA15627  (219)  KDVHAKRPKDWDDREYIEDPDEVKPEGYDSIPKQIPDPKDKKPDTWDEDE
          O.sativa_Os05g43170.1  (217)  KESNAKKPKDWDDREYIEDPDEVKPEGYDSIPKEIPDPKDKKPESWDDDD
              S.bicolor_TA24664  (218)  KDVNAKKPKDWDDREYIEDPDQVKPEGYDSIPKQIPNPKDKKPESWDDDE
              Z.mays_BPS_22383   (216)  KDVNAKKPKDWDDREYIEDPDQVKPEGYDSIPKEIPDPKDKKPESWDDDD
                P.patens_164102 (213)  KDLSAKKPEDWDDNEFIPDPEDHKPEGYDSIPKEIPDLDAKKPEBWDDES
           C.reinhardtii_TA11983 (212)  KDPKASKPEDWDEREEIADPEDKKPEGWDDIPATIADKDAKKPEDWDDEE
              P.pinaster_TA4383  (212)  KDPNAKKPEDWDDKEYIPDPEDKKPEGYDDIPKEIPDPDATKPEDWNDEE
                P.taeda_TA5639   (212)  KDPNAKKPEDWDDKEYIPDPEDKKPEGYDDIPKEIPDPDATKPEDWNDEE
             W.mirabilis_TA538   (212)  KDPEAKKPDDWDDKEFIPDPEDKKPEGYDDIPKEIPDPDATKPEDWDBEE
            P.sitchensis_TA20930 (212)  KDPNAKKPEDWEDKEYIPDPEDKKPEGYDDIPEEIPDSDATKPEDWDDEE
            B.distachyon_TA448   (214)  RDPEAKKPEDWVDEEYIPDPEDKKPEGYDDIPKEITDPEATKPEDWDDEE
          O.sativa_Os03g0832200  (215)  RDPEAKKPEDWDDNEYIPDPEDKKPEGYDDIPKEITDPEATKPEDWDDEE
              H.vulgare_TA38555  (215)  RDPDAKKPEDWEDEEYLPDPEDKKPEGYDDIPEEITDPATKPEDWDDEE
             T.aestivum_TA74192  (215)  RDPNAKKPEDWEDEEFLPDPEDKKPEGYDDIPKEITEPDATKPEDWDDEE
              S.bicolor_TA25211  (221)  KDPEAKKPEDWDDKEYIPDPEDKKPEGYDDIPKEIPDPDAKKPEDWDDEE
            H.vulgare_BPS_7785   (215)  KDPEAKKPEDWDDKEYIPDPEDVKPEGYDDIPKEVTDPDAKKPEDWDDEE
             T.aestivum_TA50840  (238)  KDPEAKKPEDWDDKEYIPDPEDVKPEGYDDIPKEVTDPDAKKPEDWDDEE
              S.bicolor_TA20922  (215)  KDPEAKKPEDWDDKEYIPDPEDKKPEGYDDIPKEIPDPDAKKPEDWDDEE
                Z.mays_TA170881  (215)  KDPEAKKPEDWDDKEYIPDPEDKKPEGYDDIPKEIPDPDAKKPEDWDDEE
          O.sativa_Os07g0246200  (219)  KDPEAKKPEDWDDKEYIPDPEDKKPEGYDDIPKEIPDPDAKKPEDWDDEE
            A.trichopoda_TA1102  (211)  KDPEAKKPEDWDDKEYIPDPEDKKPEGYDDIPKEIVDSEAQKPEDWDDEE
       A.thaliana_AT1G09210_CRT2 (212)  KDPSAKKPEDWDEQEYISDPEDKKPDGYDDIPKEIPDTDSKKPEDWDDEE
               B.napus_BPS_28478 (212)  KDPSAKKPEDWDEQEYIPDPEDKKPDGYDDIPKEIPDTDAKKPEDWDEEE
       A.thaliana_AT1G56340_CRT1 (212)  KDPSAKKPEDWDDKEYIPDPEDTKPAGYDDIPKEIPDTDAKKPEDWDDEE
               B.napus_TA20659   (212)  KDPSAKKPEDWDDKEYIPDPEDTKPAEYDDIPKEIPDADAKKPEDWDDEE
              A.formosa_TA9419   (216)  KDPEAKKPEDWDDKEYIPDPEDTKPEGYDDIPAEIPDADAKKPEDWDDEE
                C.annuum_TA4292  (217)  KDPSAKKPEDWDDKEFIDDPEDKKPEGYDDIPEEITDPDAKKPEDWDDEE
         S.habrochaites_TA1435   (217)  KDPSAKKPEDWDDKEFIDDPEDKKPEGYDDIPEEITDPEAKKPEDWDDEE
          S.lycopersicum_TA36564 (217)  KDPSAKKPEDWDDKEFIDDPEDKKPEGYDDIPEEITDPEAKKPEDWDDEE
             S.tuberosum_TA24720 (217)  KDPSAKKPEDWDDKEFIDDPEDKKPEGYDDIPEEITDPEAKKPEDWDDEE
             G.hirsutum_TA20990  (218)  KDPEAKKPEDWDDKEYIPDPEDKKPEGYDDIPKEIPDPDAKKPEDWDDEE
            G.raimondii_TA8857   (218)  KDPEAKKPEDWDDKEYIPDPEDKKPEGYDDIPKEIPDPDAKKPEDWDDEE
            G.raimondii_TA8860   (214)  KDPEAKKPEDWDDKEYIPDPEDKKPEGYDDIPKEIPDPDAKKPEDWDDEE
                  I.nil_TA5002   (216)  KDPEAKKPEDWIDDPEDKKPEGYDDIPKEIPDLDAKKPEDWDDEE
              C.endivia_TA1106   (213)  KDPEAKKPEDWDEKEYISDPEDKKPEGYDDIPKEIPDPDAKKPEDWDDEE
           C.solstitialis_TA9    (215)  KDPEAKKPEDWDEKEFIADPEDKKPEGYDDIPEEIADPDAKKPEDWDEEE
               H.annuus_TA7525   (215)  KDPEAKKPEDWDEKEFIPDPEDKKPEGYDDIPKEIPDPDAKKPEDWDDEE
          H.argophyllus_TA1300   (215)  KDPEAKKPEDWDEKEFIPDPEDKKPEGYDDIPKEIPDPDAKKPEDWDDEE
              L.serriola_TA711   (215)  KDPEAKKPEDWDEKEFIPDPEDKKPDGYDDIPKEISDPDAKKPEDWDDEE
             O.basilicum_TA646   (240)  KDPEAKKPEDWDDRENIPDPEDKKPEGYDDIPKEIPDSEAKKPEDWDDEE
              B.vulgaris_TA7257  (215)  KDPEAKKPEDWDDKEFIPDPEDKKPEGYDDIPAEITDPEAKKPEDWDDEE
            M.domestica_TA24948  (215)  KDPEAKKPEDWEDKEYIPDPEDAKPEGYDDIPKEITDPDAKKPEDWDDEE
              P.persica_TA3474   (214)  KDPEAKKPEDWEDQEYIPDPEDKKPEGYDDIPKEIADSDAKKPEDWDDEE
                G.max_BPS_38275  (214)  KDPEAKKPEDWDDKEYIPDPEDKKPEGYDDIPKELPDPEAKKPEDWDDEE
             P.vulgaris_TA3122   (218)  KDPEAKKPEDWDDKEYIPDPEDKKPEGYDDIPKEIPDTEAKKPEDWDDEE
             L.japonicus_TA548   (209)  KDPEAKKPEDWDDKEYIPDPEDKKPEGYDDIPESIPDTDAKKPEDWDDDE
         M.truncatula_AC149474   (214)  KDPEAKKPEDWDDKEFIPDPEDKKPEGYDDIPKEVADPDAKKPEDWDDEE
         P.trichocarpa_133.107   (212)  KDPEAKKPEDWDDKEYIPDPEDKKPEGYDDIPKELPDPDAKKPEDWDDEE
         P.trichocarpa_729432    (210)  KDPEAKKPEDWDDKEYIADPEDKKPEGYDDILKELPDPEAKKPEDWDDEE
             R.communis_U74630   (210)  KDPEAKKPEDWDEKEYIPDPEDKKPEGYDDIPKEIPDPDAKKPEDWDDEE
             V.vinifera_TA38405  (216)  KDPEAKKPEDWDDKEYIPDPEDEKPEGYDDIPKEIPDPDAKKPEDWDDEE
                      Consensus  (251)  KDPEAKKPEDWDDKEYIPDPEDKKPEGYDDIPKEIPDPDAKKPEDWDDEE
```

FIGURE 4 (continued)

```
                                            301                                                    350
            A.formosa_TA8804   (275) DGIWRPPKIPNPAYKGPWKRKRIKNPNYKGKWKIPWIDNPEFEDDPDLYV
           C.maculosa_TA223    (272) DGIWRPPKIPNPAYKGPWKPKKIKNPNYKGKWKIPWIDNPEFEDDPDLYV
          P.trifoliata_TA7309  (257) DGLWKPPKIPNPAYKGLWRPKRIKNPNYKGKWKIPYIDNPEFEDDPDLYV
              E.esula_TA10075  (265) NGIWRPPMVPNPAYKGPWKPKRIKNPNYKGKWKIPYIDNPEFEDDPDLYV
          M.domestica_TA28184  (270) NGLWKAPKIPNPAYKGPWRPKKIKNPNYKGKWKIPWIDNPEFEDDPDLYV
         M.truncatula_TA23636  (265) DGIWKRPKIPNPAYKGPWKRKKIKNPNYKGKWKTPWIDNPEFEDDPDLYV
    V.vinifera_GSVIVT00025039001 (273) DGLWKPPKIPNPAFKGPWRRKKIKNPNYKGKWKNQWIDNPEFEDDPDLYV
     A.thaliana_AT1G08450_CRT3 (268) NGLWEPPKIPNSAYKGPWKAKRIKNPNYKGKWKNPWIDNPEFEDDPDLYV
            B.napus_BPS_33882  (271) NGPWEAPKIPNPAYKGPWKAKKIKNPNYKGKWKNPWIDNPEFEDDPDLYV
          G.raimondii_TA11257  (268) DGIWKPPKIPNPAYKGPWKRKKIKNPNYKGKWKTPWIDNPEFEDDPDLYV
          P.trichocarpa_VII.148 (274) DGIWRPPKIPNPAYKGPWKRKKIKNPNYKGKWKIPWIDNPEFEDDPDLYV
             H.vulgare_TA32081 (270) DGIWKPRRIPNPAYKGQWKRKKIKNPNYKGKWKIPWIDNPEFEDDPDLYV
           T.aestivum_TA53764  (270) DGIWKPRRIPNPAYKGQWKRKKIKNPNYKGKWKIPWIDNPEFEDDPDLYV
        O.sativa_Os01g67054.1  (287) DGIWKPRMIPNPAYKGPWKRKKIKNPNYKGKWKIPWIDNPEFEDDPDLYV
               Z.mays_TA15627  (269) DGIWKPRMVSNPAYKGPWKRKRTKNPNYKGKWKTPWIDNPEFEDDPDLYV
        O.sativa_Os05g43170.1  (267) DGVWKPRMINPEYKGRWKRKKIKNPNYKGKWKIPWIDNPEFEDDPDLYV
            S.bicolor_TA24664  (268) DGTWKPRMIPNPEYKGPWKRKKIKNPNYKGKWKTPWIDNPEFEDDPDLYV
            Z.mays_BPS_22383   (266) DGTWKPRMIPNPEYKGPWKRKKIKNPNYKGKWKTPWIVNPEFEDDPDLYV
             P.patens_164102   (263) DGEWEAPLIPNPEFKGPWTPKEIKNPNYGKWKAPLISNPEFEEDPDLYV
          C.reinhardtii_TA11983 (262) DGTWEPPMIPNPEYKGEWKAKMIKNPAYKGIWVAPDIDNPDYVHDDKLYN
            P.pinaster_TA4383  (262) DGEWTAPTIANPEYKGPWNPKKIKNPNYKGKWKAPIIDNPDFKDDPELYV
              P.taeda_TA5639   (262) DGEWTAPTIANPEYKGPWKPKKIKNPNYKGKWKAPIIDNPDFKDDPELYV
            W.mirabilis_TA538  (262) DGEWTAPTIPNPEYKGPWKPKKIKNPNYKGKWKAPMIDNPDFKDDPNLYV
          P.sitchensis_TA20930 (262) DGEWKAPTIPNPEYKGPWKPKKIKNLKYKGKWVAPMIDNPDFKDDPELYV
            B.distachyon_TA448 (264) DGEWTAPTMPNPEYKGPWTQKKIKNPEYKGKWKAPLIDNPDFKDDPYIYA
        O.sativa_Os03g0832200  (265) DGEWTAPTIPNPEYKGPWNQKKLKNPNYKGKWKAPTIPNPDYKDDPYIYA
             H.vulgare_TA38555 (265) DGEWTAPTIPNPEYKGPWIQKKFKNPNFKGKWKAPLIDNPEYKDDPYIYA
           T.aestivum_TA74192  (265) DGEWTAPTIPNPEYKGPWIQKKIKNPNFKGKWKAPLIDNPEYKDDPYIYA
            S.bicolor_TA25211  (271) DGEWTAPTIPNPEYKGPWKQKKIKNPDYKGKWKAPLIDNPDFKDDPYIYA
             H.vulgare_BPS_7785 (265) DGEWTAPTIPNPEYKGPWKQKKIKNPNYQGKWKAPMIANPDFQDDPYIYA
           T.aestivum_TA50840  (288) DGEWTAPTIPNPEYKGPWKQKKIKNPNYQGKWKAPMIANPDFKDDPYIYA
            S.bicolor_TA20922  (265) DGEWTAPTIPNPEYKGPWKQKKIKNPNYQGKWKAPMIDNPDFKDDPYIYA
              Z.mays_TA170881  (265) DGEWTAPTIPNPEYKGPWKQKKIKNPNYQGKWKAPMIDNPDFKDDPYIYA
        O.sativa_Os07g0246200  (269) DGEWTAPTIPNPEYKGPWKQKKIKNPNYQGKWKAPMIDNPDFKDDPYIYA
            A.trichopoda_TA1102 (261) DGEWKAPMIPNPEYKGPWKPKKIKNPNYQGKWKAPMIDNPDFKDDPEIYV
     A.thaliana_AT1G09210_CRT2 (262) DGEWTAPTIPNPEYMGEWKPKQIKNPNYKGKWEAPLIDNPDFKDDPELYV
            B.napus_BPS_28478  (262) DGEWTAPTVPNPEYMGEWKPKQIKNPNYKGKWEAPEIDNPDFKNDSELYV
     A.thaliana_AT1G56340_CRT1 (262) DGEWTAPTIPNPEYNGEWKPKKIKNPAYKGKWKAPMIDNPEFKDDPELYV
             B.napus_TA20659   (262) DGEWTAPTIPNPEYNGEWKPKKIKNPNYKGKWKAPMIDNPDFKDDPELYV
           A.formosa_TA9419    (266) DGEWAAPTIANPEYKGPWKAKKIKNPNYKGKWKAPMIDNPDFKDDPDIYV
             C.annuum_TA4292   (267) DGEWTAPTIPNPEYKGPWKAKKIKNPNYKGKWKAPMIDNPDFKDDPDLYV
         S.habrochaites_TA1435 (267) DGEWTAPTIPNPEYKGPWKAKKIKNPNYKGKWKAPMIDNPDFKDDPDLYV
         S.lycopersicum_TA36564 (267) DGEWTAPTIPNPEYKGPWKAKKIKNPNYKGKWKAPMIDNPDFKDDPDLYV
           S.tuberosum_TA24720 (267) DGEWTAPTIPNPEYKGPWKAKKIKNPNYKGKWKAPMIDNPDFKDDPDLYV
           G.hirsutum_TA20990  (268) DGEWTPSTIPNPEYKGPWKPKKIKNPNYKGKWKAPMIDNPDFKDDPDLYV
           G.raimondii_TA8857  (268) DGEWTPSTIPNPEYKGPWKPKKIKNPNYKGKWKAPIIDNPDFKDDPDLYV
           G.raimondii_TA8860  (264) DGEWTPSTIPNPEYKGPWNPKKIKNPNYKGKWKAPMIDNPDFKDDPDLYV
                I.nil_TA5002  (266) DGEWTAPTVANPEYKGPWTPKKIKNPNYKGKWKAPMIDNPDFKDDPDLYV
             C.endivia_TA1106  (263) DGEWTVPTIPNPEYKGPWKAKKIKNPNYKGKWKAPIIDNPDFKDDPELYV
          C.solstitialis_TA9   (265) DGEWTVPTIPNPEYKGPWKAKKIKNPNYKGKWKAPLIDNPDFKDDPDLYV
              H.annuus_TA7525  (265) DGEWTVPTIPNPEYKGPWKAKKIKNPNYKGKWKAPMIDNPDFKDDPDLYV
         H.argophyllus_TA1300  (265) DGEWTVPTIPNPEYKGPWKAKKIKNPNYKGKWKAPMIDNPDFKDDPDLYV
             L.serriola_TA711  (265) DGEWTVPTIPNPDYKGPWKAKKIKNPNYKGKWKAPMIDNPDFKDDPDLYV
            O.basilicum_TA646  (290) DGEWTAPTIPNPEYKGPWKAKKIKNPNYKGKWKAPLIDNPEFKDDPELYV
             B.vulgaris_TA7257 (265) DGEWTAPTIPNPEYKGPWKAKKIKNPNYKGKWKAPMIDNPEFKDDPELYV
           M.domestica_TA24948 (265) DGEWTAPTIPNPEYKGEWKPKKTKNPNFKGKWKAPLIDNPEFKDDPELYV
             P.persica_TA3474  (264) DGEWTAPTIPNPEYKGEWKPKKIKNPNFKGKWKAPLIDNPEFKDDPELYV
             G.max_BPS_38275   (264) DGEWTPPTIANPEYKGPWKAEKIKNPNYKGKWKAPLIDNPDFKDDPDLYV
            P.vulgaris_TA3122  (268) DGEWTPPTIPNPEYKGPWKAKKIKNPNFKGKWKAPIIDNPDFKDDPNLYV
            L.japonicus_TA548  (259) DGEWTAPTIANPEYKGPWTPKKIKNPNYQGKWKAPTIDNPDFKDDPDLYV
         M.truncatula_AC149474 (264) DGEWTAPTIPNPEYKGPWKPKKIKNPNYSGKWKAPLIDNPDFKDDPDIYV
         P.trichocarpa_133.107 (262) DGEWTAPTIPNPEYNGPWKPKKIKNPNYQGKWKAPKIDNPDFKDDPELYV
         P.trichocarpa_729432  (260) DGEWTAPTIPNPEYKGPWKPKKIKNPNYQGKWKAPIIDNPDFKDDPELYV
            R.communis_U74630  (260) DGEWTAPTIANPEYKGPWKPKKIKNPNYKGKWKAPMIDNPDFKDDPEIYV
            V.vinifera_TA38405 (266) DGEWTAPTIANPEYKGPWKPKKIKNPNYKGKWKAPMIDNPEFKDDPEIYV
                    Consensus (301) DGEWTAPTIPNPEYKGPWK KKIKNPNYK GKWKAPMIDNPDFKDDPDLYV
```

FIGURE 4 (continued)

```
                                        351                                              400
         A.formosa_TA8804         (325) LKPIKYVGIEVWQVKAGSVFDNVLICDDPGYAKQVIEDILFKNKEAEKEA
        C.maculosa_TA223          (322) LKPIKYVGIEVWQVKAGSVYDNILICDDPEYAKDVIQEVFT-NREIEKEA
        P.trifoliata_TA7309       (307) LKPIKYVGIEVWQVKAGSVYDNILICDDPAYAKQVVEEVLS-NREIEKEG
           E.esula_TA10075        (315) LKPIKYVGIEVWQVKSGTIFDNVLICDEPEYAKEVVQEVLA-NREIEKEA
        M.domestica_TA28184       (320) LKPIKYVGIEVWQVKAGSVFDNVLICDDPDYAKQVVEEVFA-NREVEKDA
       M.truncatula_TA23636       (315) LKPIKYVGIEVWQVKGGSVFDNILICDDPEYAKQVVDEVFA-NREIEKEA
V.vinifera_GSVIVT00025039001      (323) LKPIKYVGIEVWQVKAGAIYDNILICDDPEYAKQVVEEVFA-HRESEKEA
     A.thaliana_AT1G08450_CRT3    (318) LKSIKYAGIEVWQVKAGSIFDNILICDDPAYARSIVDDYFAQHRESEKEL
            B.napus_BPS_33882     (321) LKPIKYIGIEVWQVKAGSIFDNILITDDPQYARTMVDDYFEQHRESEKEL
         G.raimondii_TA11257      (318) LRPIKYVGIEVWQVKAGSVFDNILICDDPQYAREVVEDIWARNREAEKEA
      P.trichocarpa_VII.148       (324) LKPIKYVGIEVWQVKAGSIFDNILICDDPQYAREIVKDVFQ-NREIEKDA
          H.vulgare_TA32081       (320) LKPLKYIGIEVWQVKAGSVFDNILICDDPEYAKQVADETWGANKEAEKEA
         T.aestivum_TA53764       (320) LKPLKYIGIEVWQVKAGSVFDNILICDDPEYAKQVADETWGANKEAEKEA
        O.sativa_Os01g67054.1     (337) LKPLKYIGIEVWQVKAGSVFDNILICDDPEYARKAAEETWGANKEAEKEA
            Z.mays_TA15627        (319) LKPLKYIGIEVWQVKAGSVFDNILICDDPEYARKVVEETWGANREAEKEA
        O.sativa_Os05g43170.1     (317) LKPLQYVGIEVWQVKAGSVFDNILICDDPEYARSVVDEVRAANKEAEKEA
          S.bicolor_TA24664       (318) LKPLQYVGIEVWQVKAGSVFDNILICDDPDYARHVVDETFAANKEAEKEA
             Z.mays_BPS_22383     (316) LKPLQYVGIEVWQVKAGSVFDNILICDDPDYARHVVDETFAANKEAEKEA
            P.patens_164102       (313) LPPLKYFGMELWQVKAGSVFDNILVTDDPEYAKKFAEETWGNIKEGEKEM
       C.reinhardtii_TA11983      (312) FKDLKFVGFELWQVKSGSIFDNILVTDDLEAAKKFAEDTWGKHKDEEKAM
          P.pinaster_TA4383       (312) FPNLKYLGIELWQVKSGTLFDNILISDDPEYAKKLAEETWAKHKDAEKEA
             P.taeda_TA5639       (312) FPNLKYLGIELWQVKSGTLFDNILISDDPEYAKKLAEETWAKHKDAEKEA
          W.mirabilis_TA538       (312) FPNLRYIGIELWQVKSGTLFDNILICDDPAYAKQLAEETWGKHKDAEKEA
         P.sitchensis_TA20930     (312) FPSLKYLGIELWQVKSGTLFDNILCDDPEYAKKVAEETWGKHKDAEKEA
         B.distachyon_TA448       (314) FDSLKHIGIELWQVKSGTLFDNILITDDPEYAKKVAEETWAKHKDAEKAA
        O.sativa_Os03g0832200     (315) FDSLNHIGIELWQVKSGTLFDNILITDDPEYAKKFAEETWAKHKDAEKAA
          H.vulgare_TA38555       (315) FDSLKHIGIELWQVKSGTLFDNILITDDPEYAKKFAEETWGKHKDAEKAA
         T.aestivum_TA74192       (315) FDSLKHIGIELWQVKSGTLFDNILITDDPEYAKKFAEETWGKHKDAEKAA
          S.bicolor_TA25211       (321) FDSLKHIGIELWQVKSGTLFDNILITDDPEYAKKLAVETWGKQKDAEKAA
          H.vulgare_BPS_7785      (315) FDSLKYIGIELWQVKSGTLFDNILITDDAALAKTFAEETWAKHKDAEKAA
         T.aestivum_TA50840       (338) FDSLKYIGIELWQVKSGTLFDNILITDDAALAKTFAEETWAKHKEAEKAA
          S.bicolor_TA20922       (315) FDSLKYIGIELWQVKSGTLFDNFIITDDPALAKTFAEETWGKHKEAEKAA
            Z.mays_TA170881       (315) FDSLKYIGIELWQVKSGTLFDNIIITDDPALAKTFAEETWGKHKEAEKAA
        O.sativa_Os07g0246200     (319) FDSLKYIGIELWQVKSGTLFDNFLITDDPELAKTFAEETWGKHKDAEKAA
       A.trichopoda_TA1102        (311) YPNLKYVAIELWQVKSGTLFDNVLVCDDPEYAKKLVEETWGKQKDAEKAA
      A.thaliana_AT1G09210_CRT2   (312) FPKLKYVGLELWQVKSGSLFDNVLICDDPDYAKKLADETWGKLKDAEKAA
            B.napus_BPS_28478     (312) FPKLKYVGIELWQVKSGSLFDNVLICDDPDYAKKLADETWGKLKDAEKAA
      A.thaliana_AT1G56340_CRT1   (312) FPKLKYVGVELWQVKSGSLFDNVLVSDDPEYAKKLAEETWGKHKDAEKAA
            B.napus_TA20659       (312) FPKLKYVGVELWQVKSGSLFDNVLVSDDPEYAKQLAEETWGKLKDAEKAA
         A.formosa_TA9419         (316) YPKLKYVGIELWQVKSGTMFDNVLVCDDPEYAKKLAEETWGKHKDAEKAA
          C.annuum_TA4292         (317) FPKLKYVGVELWQVKSGTLFDNVVITDDPEYAKSVAEETWGKQKDAEKAA
       S.habrochaites_TA1435      (317) FPKLKYVGVELWQVKSGTLFDNVVICDDPEFAKSIAEETWGKQKDAEKAA
        S.lycopersicum_TA36564    (317) FPKLKYVGVELWQVKSGTLFDNVVICDDPEFAKSIAEETWGKQKDAEKAA
         S.tuberosum_TA24720      (317) FPKLKYVGVELWQVKSGTLFDNVVICDDPEYAKSIAEETWGKQKDAEKAA
         G.hirsutum_TA20990       (318) FPNLKYVGIELWQVKSGTMFDNILVADDVEYAKKLAEETWGKQKDAEKAA
         G.raimondii_TA8857       (318) FPNLKYVGIELWQVKSGTMFDNILVADDVEYAKKLAEETWGKQKDAEKAA
         G.raimondii_TA8860       (314) FPSLKYVGIELWQVKSGTMFDNILVADDVEYAKKLAEETWGKQKDAEKAA
             I.nil_TA5002         (316) FPNLKYVGIELWQVKSGTLFDNVLVSDDPEYAKKLAEETWAKNKDGEKAA
           C.endivia_TA1106       (313) FPKLKYVGIELWQVKSGTLFDNVLICDDPEYAKQLVEETWAKQKDAEKAA
        C.solstitialis_TA9        (315) FPKLKYVGIELWQVKSGTLFDNVLICDDPEYAKQVAEETWGKQKDAEKAA
           H.annuus_TA7525        (315) FPKLKYVGIELWQVKSGTLFDNVLICDDPEYAKQVAEETWGKQKDAEKAA
       H.argophyllus_TA1300       (315) FPKLKYVGIELWQVKSGTLFDNVLICDDPEYAKQVAEETWGKQKDAEKAA
          L.serriola_TA711        (315) FPKLKYVGIELWQVKSGTLFDNVLICDDPEYAKQVAEQTWGKQKDAEKAA
         O.basilicum_TA646        (340) FPKLKYVGIELWQVKSGTLFDNVLIADDPEYAKEAEETWGKQKDAEKAA
          B.vulgaris_TA7257       (315) YPKLRYVGVELWQVKSGTLFDNVLVCDDPEYAKQLAEETWGKQKDAEKAA
         M.domestica_TA24948      (315) YPNLKYVGIELWQVKSGTLFDNILITDEPEYAKQLAEETWGKQKDAEKAA
          P.persica_TA3474        (314) YPNLKYVGIELWQVKSGTLFDNILITDEPEYAKQLAEETWGKQKDAEKAA
            G.max_BPS_38275       (314) FPNLKYVGIELWQVKSGTLFDNVLITDDPEYAKQLVEETWGKHKDAEKAA
          P.vulgaris_TA3122       (318) FPNLKYVGIELWQVKSGTLFDNVLITDDIEYAKQLAEETWGKHKDAEKTA
         L.japonicus_TA548        (309) YPKLKYVGIELWQVKSGTLFDNVLITDDPEYAKQVAEETWGKQKDAEKAA
        M.truncatula_AC149474     (314) FPKLKYVGIELWQVKSGTLFDNVVITDDPEYAKQVAEETWGKQKDAEKAA
       P.trichocarpa_133.107      (312) YPNLRYVGIELWQVKSGTLFDNVLVSDDPEYAKQLAEETWGKQKDAEKAA
       P.trichocarpa_729432       (310) YPDLRYVGIELWQVKSGTLFDNVLVSDDPEYAKQMAEETWGKQKDAEKAA
         R.communis_U74630        (310) YPNLKYVGIELWQVKSGTLFDNVLICNDPEYAKQLAEETWGKNKDAEKAA
          V.vinifera_TA38405      (316) FPDLKYVGIELWQVKSGTLFDNVLICDDPEYAKQLVEETWAKYKDAEKAA
                       Consensus (351) FP LKYVG[IELWQVK]SGTLFDNILICDDPEYAK VAEETWGKQKDAEKAA
```

FIGURE 4 (continued)

```
                                            401                                                450
         A.formosa_TA8804        (375) FEEAEKLR--RAREEEEAQRAR----EEGERRRNERGHDRGY---RDRER
         C.maculosa_TA223        (371) LEEAEKAK--KAREEEEAQRAR----EEGERRKRERGYDRRH---RDKER
       P.trifoliata_TA7309       (356) FEEAEKVR--KVREEEEAQRAR----EEGEKRRRERGYDRR----RYRDR
           E.esula_TA10075       (364) FEEAEKIR--RAREEEEAQRAR----EEGERRRRERGHDRR------RDR
        M.domestica_TA28184      (369) LEEAEKRR--KAQEEEEAQRAR----EEGERRRRDRDRGHR-------DR
       M.truncatula_TA23636      (364) FEEAEKVR--KAQEEEEAQRAR----EDGERRRKERGYDR----------
V.vinifera_GSVIVT00025039001     (372) FEEAEKVR--KAREEEEAQRAR----EEGERRRRERGHDRR-------YR
    A.thaliana_AT1G08450_CRT3    (368) FAEAEKER--KAREDEEARIAR----EEGERRRKERDHRYG--------D
          B.napus_BPS_33882      (371) FAEAEKER--KAREDEESRKAR----EEGERRRKERDHRYG--------D
         G.raimondii_TA11257     (368) FEEAEKER--RAREEEEAKTPR----EEGEKRRKERDHRHR--------D
       P.trichocarpa_VII.148     (373) FEEAEKVR--RAREEEEAQRAR----EEGEKRRKERGYRK----------
          H.vulgare_TA32081      (370) FEEAEKER--KAREDKEAQQAR----EEGERRRRERGDRHR-----GRDH
         T.aestivum_TA53764      (370) FEEAEKER--KAREDKEAQQAR----EEGERRRRERGDRHR-----GRDH
        O.sativa_Os01g67054.1    (387) FEEAEKER--KAREDKEAERAR----EEGERRRRERGDRHR-----GRD-
            Z.mays_TA15627       (369) FEEAEKER--KAREDREGQKAK----DDGGRHRIHR--------------
        O.sativa_Os05g43170.1    (367) FEEAEKRR--KAREDEEARRAR----EEGEKRRRDR-DRHR-----GRDR
          S.bicolor_TA24664      (368) FEGAERKR--KAREEEEARRAR----EEGERRRRER-DRDR-----GRDR
          Z.mays_BPS_22383       (366) FEGAERKR--KAREEEEARRAR----EEGERRRRER-DRDR-----GRDR
           P.patens_164102       (363) FDELENKN----REEQ--K------IDDNDPNEEK---------------
       C.reinhardtii_TA11983     (362) FDKVKKE----EDEKKAKDAPPPPVDAEAAEEEDDEYEDR-------HE
          P.pinaster_TA4383      (362) FDEAEKKKEEEEEKEKE-PDDED---TDEEEEKSDDEDADELDN-----EH
           P.taeda_TA5639        (362) FDEAEKKKEEEEEKEKESDDEED---TDEKEEKSDDEDADELDD-----EH
          W.mirabilis_TA538      (362) FEAAEEKKR------EE------------EEKSDDDDAEGSD-------S
        P.sitchensis_TA20930     (362) FEAEEKKN------DE-------------EESKDEEDEDTTD-------E
         B.distachyon_TA448      (364) FDEAEKK-----RLEEESASSK---DDDDLDDDERC--------------
        O.sativa_Os03g0832200    (365) FDEAEKK-----RLEEESANSK---IDDSDDDASDDEDEAD---DDKADV
          H.vulgare_TA38555      (365) FDEAEKK-----RLEEESANSN---AEDNDDTADEDEDV-----DGKAAG
         T.aestivum_TA74192      (365) FDEAEKK-----RLEEESANTK---TEDNDDAADQED------EGKAAG
          S.bicolor_TA25211      (371) FDEAEKK-----RLEEESASSK---DDDDDLDVDEDEDDAD---DDKADH
          H.vulgare_BPS_7785     (365) FDEAEKK-----KEEEDASKAG----EDDDDLDDEDADDED---KDDKAG
         T.aestivum_TA50840      (388) FDAAEKK-----KEEEDASKAG----EDDDDLDDEDADDED----KDDKAG
          S.bicolor_TA20922      (365) FDAAEKK-----KEEEEAAKGG---DDEDDDLEDEEDDEKA---DEDKAD
           Z.mays_TA170881       (365) FDEAEKK-----KEEEDAAKGG---DDEDDDLEDEEDDEKA---DEDKAD
        O.sativa_Os07g0246200    (369) FDEAEKK-----KEEEEAAKAG---EDDDDDLDDEDAEDEDK---ADEKAD
         A.trichopoda_TA1102     (361) FDEEEKRK----EEEEAKAAEA---EGSDDEKEDDADADAD-------AD
     A.thaliana_AT1G09210_CRT2   (362) FDEAEKKN----EEEESKDAP----AESDAEDEPEDDEGG--------DD
          B.napus_BPS_28478      (362) FDEIEKKK----EEEESKDAP----AETDAEDEAEEEDEG--------DE
     A.thaliana_AT1G56340_CRT1   (362) FDEAEKKR----EEEESKDAP----AESDAEEEAEDDDNEG-------DD
          B.napus_TA20659        (362) FEEAEKKR----EEEESKDAPT---ADSDAEDEQEDDDHEG-------DE
         A.formosa_TA9419        (366) FEEAEKK-----IEEEESKNDP---ADSDDEKAGDDDDAEG-------ED
           C.annuum_TA4292       (367) FEEAEKK-----REEEESKAAP---ADSDAEDDDEADSDDA-------DD
       S.habrochaites_TA1435     (367) FEEAEKK-----REEEESKNAP---AESDADEDDEADEADS-------DD
       S.lycopersicum_TA36564    (367) FEEAEKK-----REEEESKNAP---AESDADEDDEA--------------
         S.tuberosum_TA24720     (367) FEEAEKK-----REEEESKNAP---AESDAEEDDEADEADS-------DD
         G.hirsutum_TA20990      (368) FEEAEKK-----REEE-SKDDP---VDSDAEDEDDADDTEG-------HE
         G.raimondii_TA8857      (368) FEEAEKK-----REEEESKDAP---VDSDAEDEDGADDTEG-------HE
         G.raimondii_TA8860      (364) FEEEEKK-----REEEESKDEP---VDSDADDDDDTDDGE--------GS
            I.nil_TA5002         (366) FDEAEKK-----IAEEESKDDP---ADSDAEDEDDDADDTDGDDADSKSE
         C.endivia_TA1106        (363) FEELEKK-----REEEELKDDH---VDSDADDEGNDSDEAE-------PE
        C.solstitialis_TA9       (365) FEELEKK-----KEEEESKDDP---ADSDAEN-----DDAE-------PE
          H.annuus_TA7525        (365) FEELEKK-----REEEETKDDP---VDSDVEDN----DDAE-------AE
        H.argophyllus_TA1300     (365) FEELEKK-----REEEETKDDP---VDSDVEDN----DDAE-------AE
          L.serriola_TA711       (365) FEELEKK-----REEEESKDDP---ADSDADN-----DDAE-------PE
         O.basilicum_TA646       (390) FEEAEKK-----REEEESKNDG---VDSDADDG--EESDAE-------AD
          B.vulgaris_TA7257      (365) FEELEKK-----REEEETKDDP---VESDAEDEDEAEADDS-------DK
         M.domestica_TA24948     (365) FEEAEKK-----QEEE--AKDP---VDSDAEEEDDADTDDA-------ED
          P.persica_TA3474       (364) FEELEKK-----LQEEESKEDP---VDSDAEDDDADAEDGE-------ES
           G.max_BPS_38275       (364) FEEAEKK-----REEEESKDDP---VDSDADEEEEDADEAG-------ND
         P.vulgaris_TA3122       (368) FEEAEKK-----REEEESKEDP---VDSDAEDDDEDSDEAG-------ND
         L.japonicus_TA548       (359) FEEAEKK-----REEEESKEDP---ADSDAEDEEDTDEASH-------DS
       M.truncatula_AC149474     (364) FEEAEKK-----KEEEETKDDP---VDSDAEEEDEDANEVS-------HD
        P.trichocarpa_133.107    (362) FEEAEKKK----ADEEETNEDA---AGSDAEDEDETDDVEG-------ED
        P.trichocarpa_729432     (360) FEEVEKK-----RDEEESKEDP---ADSDAEEEDAGDAEG--------ED
          R.communis_U74630      (360) FDEAEKK-----REEEESKEDP---ADSDADEDDDDADDTE--------GE
         V.vinifera_TA38405      (366) FDEAEKK-----REEEESKEDP---VDSDVEDEDDADADAA-------EA
               Consensus         (401) FEEAEKK     REEEES        D DEE EDE DDD              D
```

FIGURE 4 (continued)

```
                                        451                                    489
         A.formosa_TA8804       (416)   YKDKYRRH----------------DRRRDYLDDYHDEL
        C.maculosa_TA223        (412)   YKDRYRKY----------------NRRDY-LDDYHDEL
       P.trifoliata_TA7309      (396)   YRDKYRRH----------------DYLD---DDYHDEL
          E.esula_TA10075       (402)   YRDRYRKH----------------NPRDD-FDDYHDEL
       M.domestica_TA28184      (406)   HRDRYRRH----------------RHWDD-YDHDEL--
       M.truncatula_TA23636     (398)   HRDRHRDR-------------------YRKDE-L-----
  V.vinifera_GSVIVT00025039001  (409)   DRERYRKH----------------YRRVC-ISYA----
    A.thaliana_AT1G08450_CRT3   (404)   RRRRYKRP----------------NPRDY-MDDYHDEL
          B.napus_BPS_33882     (407)   RRRRYKRP----------------NPRDY-MDDYHDEL
       G.raimondii_TA11257      (404)   RRH-RRRH----------------DPRDY-LDDYHDEL
      P.trichocarpa_VII.148     (407)   P---RRRH----------------DPRDY-LDDYHDEL
         H.vulgare_TA32081      (409)   YKDRYKR-----------------RNRDHWDD-YHDEL
        T.aestivum_TA53764      (409)   YKDRYKR-----------------RNRDHWDD-YHDEL
       O.sativa_Os01g67054.1    (425)   YKDRYKR-----------------RHRDHWDDDYHDEL
          Z.mays_TA15627        (399)   ---RHKK-----------------HYRDHWDD-YHDEL
       O.sativa_Os05g43170.1    (405)   YRDRYRG-----------------HHRRYDYHDEL
         S.bicolor_TA24664      (406)   YRDRYK------------------RHRHYDYHDEL
          Z.mays_BPS_22383      (404)   YKDRYK------------------RHRHYDYHDEL
         P.patens_164102        (386)   -DDYDED-----------------DDDDDHDEL
      C.reinhardtii_TA11983     (400)   ASGMGSIKIP--------------KEEEESGHDEL
         P.pinaster_TA4383      (403)   KEADKKEH--E-----------LDSEHKEEDKKEHDEL
          P.taeda_TA5639        (404)   KEADKKEH--E-----------LDSEHKEEDKKEHDEL
        W.mirabilis_TA538       (386)   EEDDEIE-----------------EEEEKEEKDEHDEL
       P.sitchensis_TA20930     (386)   TEEPE-------------------EE-EDNEEHDEL
       B.distachyon_TA448       (391)   --------------------------------------
      O.sativa_Os03g0832200     (404)   VAEQTKDKGDEKPQDIKVSADEKPKSSKDDSSAAKKDEL
         H.vulgare_TA38555      (402)   ASDEGKGQ------QVSADEKVEEISKDASSS-DKKDEL
        T.aestivum_TA74192      (400)   ASDE----------ENKDASGDEEISKDASSSSDKKDEL
         S.bicolor_TA25211      (410)   SDTD-------------------EAEDSEEAKHDEL
         H.vulgare_BPS_7785     (403)   SDAEDD-----------------K-DS-DDEKHDEL
        T.aestivum_TA50840      (426)   SDVES------------------DDEKHDEL
         S.bicolor_TA20922      (404)   SDAEDS-----------------K-DDSDDEKHDEL
          Z.mays_TA170881       (404)   SDAEDS-----------------K-DS-DDEKHDEL
       O.sativa_Os07g0246200    (408)   SDAEDG-----------------K-DS-DDEKHDEL
       A.trichopoda_TA1102      (397)   ADDE-------------------EEEAKHDEL
    A.thaliana_AT1G09210_CRT2   (396)   SDSESKAEETK----------SVDSEETSEKDATAHDEL
          B.napus_BPS_28478     (395)   SDTEA-KTEAK----------SEVSEETSDKDATAHDEL
    A.thaliana_AT1G56340_CRT1   (397)   SDNESKSEETK----------EAEETKEAEEETDAAHDEL
         B.napus_TA20659        (398)   SDTDSKTEETK----------VETS---SDKDDAAHDEL
         A.formosa_TA9419       (401)   ADDEEAK----------------G--DSDEDEVHDEL
          C.annuum_TA4292       (402)   ADDKSES----------------K--DDDEAA-HDEL
     S.habrochaites_TA1435      (402)   ADDKSDS----------------K--DEDT---HDEL
     S.lycopersicum_TA36564     (395)   -DDKSDS----------------K--DEDT---HDEL
        S.tuberosum_TA24720     (402)   ADDKSDS----------------K--DEDT---HDEL
         G.hirsutum_TA20990     (402)   SDSDTKS----------------D--DDDKEDAHDEL
         G.raimondii_TA8857     (403)   SDSDTKS----------------D--DEDKEDAHDEL
         G.raimondii_TA8860     (399)   ESDSSKD----------------S--AEEDAVQHDEL
            I.nil_TA5002        (408)   SKQDESK----------------S--ESKEDDAHDEL
         C.endivia_TA1106       (398)   EEEE-------------------ADDNDIKDEL
        C.solstitialis_TA9      (395)   DDDE-------------------AEESDVKDEL
         H.annuus_TA7525        (396)   EEDD-------------------AEESDVKDEL
       H.argophyllus_TA1300     (396)   EEDE-------------------AEESDVKDEL
          L.serriola_TA711      (395)   DEEE-------------------ADENDVKDEL
         O.basilicum_TA646      (423)   DADDSKI-------------DPNEDPVASVDDVHDEL
         B.vulgaris_TA7257      (400)   DDAD-------------------KSDDKDDDQHDEL
       M.domestica_TA24948      (398)   DSDAESK--------------SDSTEESAE-ESEKHDEL
          P.persica_TA3474      (399)   DSES--K--------------PDSTEESAETEAEKHDEL
          G.max_BPS_38275       (399)   SDAESKT--------------EAGEDTKEEG---VHDEL
         P.vulgaris_TA3122      (403)   SDGESKT--------------EAGEDKEDG-----HDEL
         L.japonicus_TA548      (394)   DDAESKT--------------EAGEDSADANEEDVHDEL
       M.truncatula_AC149474    (399)   SDDESKA--------------EAGEDSDETNKDDVHDEL
       P.trichocarpa_133.107    (398)   SDAET----------------KEDKDGEDEEEVHDEL
       P.trichocarpa_729432     (395)   SDAET----------------KADT-ADDEDEVHDEL
         R.communis_U74630      (395)   DDGES----------------KSDAAEDSAEDVHDEL
         V.vinifera_TA38405     (401)   EDSDSEAKLES----------ETSKEADSDDEEDKHDEL
                  Consensus     (451)   DDE K                  D  DDD HDEL
```

FIGURE 4 (continued)

```
                                    1                                                           60
A.thaliana_AT5G67220.1      (1)  ----------------------------------------MKLNLSNLRFLRTRKSLISQ-RAMT
B.napus_BN06MC20455         (1)  ------------------------------------------------------------MT
B.napus_TC79818             (1)  -----------------------------------MKPSSLLKFLRTRDSPLLRIRTMT
P.patens_149014             (1)  ------------------------------------------------------------
S.moellendorffii_443602     (1)  ------------------------------------------------------------
P.taeda_TA13257_3352        (1)  MKTRPSIARLSSISSIDNRNSHGLTFPLLPWTLKRFHFSSSSVVPMTKEASEDADNVLCS
O.sativa_LOC_Os06g49870.1   (1)  --------------------------------MRFAPILRNPRRR-RLLRSVNPSLAAMS
Sacof_DuS1L                 (1)  --------------------------------MPLRRLAPLLVSPRR--RLRSSLNPSLVAMS
S.bicolor_Sb10g029830.1     (1)  --------------------------------MPLRRLAPLLASPRR--RLRSSQNPSPATMS
Z.mays_ZM07MC04636          (1)  --------------------------------MQLRRLSPLLASPRRRLRLRSPTNPSSATMS
G.max_Glyma05g20510.1       (1)  ----------------------------------------------------MKPKPKPYSFLP
G.max_Glyma17g18490.1       (1)  ----------------------------------------------------MKPKHKPYSFLP
R.communis_TA2745_3988      (1)  ------------------------------MRSLFCLHKPLLSTSLKPLMASS
S.lycopersicum_TC206234     (1)  ------------------------MRFQLISVSSIFILNSRHHTYLHRNLSMAT
V.vinifera_GSVIVT00001954   (1)  ------------------------MKLNSWPFSPLFTSLKHLSRSIYTMASSIS
C.vulgaris_36290            (1)  ------------------------------------------------------------
V.carteri_80128             (1)  ------------------------------------------------------------
E.huxleyi_437158            (1)  ------------------------------------------------------------
Consensus                        ------------------------------------------------------------MS
```

FIGURE 9

```
                           61                                                                         120
A.thaliana_AT5G67220.1  (26) QNPDPKPDPSQVLDDILCSEQR------DGQIEE-TVDTAPASLGSPSRVLSIDTRVERAWA
B.napus_BN06MC20455      (3) QNPDPNPDPSQVLDDLLSSEQ---------------Q---PESLSSPGRVLSIDTRVEQAWA
B.napus_TC79818         (27) ITSN-----PPQVRDDLLCSDQQQQQSDLQIEK-PPEAAPASLGAPGRVLSIDTRVEQAWA
P.patens_149014          (1) --------------------------MRELVEGADIEDVNSAKRLKVEAAFAVLPHAARAWD
S.moellendorffii_443602  (1) ------------------------------------------------------IERSWD
P.taeda_TA13257_3352    (61) RVADFTLSESPHSSSEDAAEDTFEAIDCSVLSTLVDSEHSSPDSSDGCMADGSLIEKAWR
O.sativa_LOC_Os06g49870.1 (28) PPAAAHLATASDPDEDLCFTT-----ESVAPAEETAP---PL-PAPPPVSAEERVERAWA
Sacof_DuS1L             (30) P-AAAHLATAADHDEDLCAS-------AAGSEAEDLAP---SP-PLPPPPVSADERVERAWA
S.bicolor_Sb10g029830.1 (30) P-AAAHLATAADPDEDLCAS-------AAGSEAEDLAL---AP-PLPPPVSAEERVERAWA
Z.mays_ZM07MC04636      (32) P-GAAHLATAADPDEDLCAS-------AGASEAEVPAP---AP-HLPPLPVSAEERLERAWA
G.max_Glyma05g20510.1   (13) LNRFLRALQS-------RPLMAQTPTSLDAEHPSDNDQHMG--FRARSLSGESRAEQAWA
G.max_Glyma17g18490.1   (13) LTRHFRALQS-------CPLMAQTPTSLDAEHPAAADQHVG--FPARSLSGESWAERAWA
R.communis_TA2745_3988  (24) LTRTVAIDQDNDDDEVLCSSAHQEHTSFSTLPDTVSSSCLGSATPSCYLNGESRVDRAWA
S.lycopersicum_TC206234 (31) ETLNSAINGEVVDDDLLCSDATT--TSSIIEQ-EGGRHPVGLNCANGYLKGEARIERAWA
V.vinifera_GSVIVT0001954 (31) ETLTLTLPAGSPQDSNLDDHICS--EQQEHQE-CQS----SSADWPSRCLTGESRIERAWA
C.vulgaris_36290         (1) ----------------------------------------MAAQEPDAATHGQRGWE
V.carteri_80128          (1) --------------------MTVAVPPPAVPASALYEPRTTMDAAPIQRPPHADMAWE
E.huxleyi_437158         (1) ------------------------------------------------MVASAWD
Consensus               (61)         S    DE LCA                          P    LSAESRVERAWA
```

FIGURE 9 (conitued)

FIGURE 9 (continued)

```
                                    121                                                           180
A.thaliana_AT5G67220.1        (81)  HWKKLGRPKYIVAPMVDNSELPFRLLCQKYGAQAAYTPMLHSRIFTETEKYRNQEFTTCK
B.napus_BN06MC20455           (47)  HWKKLGRPKYIVAPMVDNSELPFRLLCQKYGAQAAYTPMLHSRVFTETEKYRNQEFTTCK
B.napus_TC79818               (82)  HWKKLGRPKYIVAPMVDNSELPFRLLCQKYGAQAAYTPMLHSRIFTETDNR-NKEFTTCE
P.patens_149014               (37)  HWNKLGAPKLMVAPMVDQSELPFRMLCRKYGATAAYSPMLHSRLFAQDAKYRLKEFSTCP
S.moellendorffii_443602       (45)  HWRRIGAPKFMVAPMVDQSELPFRMLCRKYGATGAYTPMLHARLFSEDRKYRNYEFTTCP
P.taeda_TA-3257_3352         (121)  HWRKLGEPKLIVAPMVDQSELPFRMLCRKYGATAAYTPMLHARLFAENPKYHKLEFTTCK
O.sativa_LOC_Os06g49870.1     (80)  HWRRLGSPKMVVAPMVDNSELPFRMLCRRYGATGAYTPMLHSRIFSENEKHRAMEFTTCK
Sacof_DuS1L                   (80)  HWRRLGSPRLLVTPMVDNSELPFRMLCRRYGADAAYTPMLHSRIFSENEKYRSMEFTTCK
S.bicolor_Sb10g029830.1       (80)  HWRRLGSPRLLVAPMVDNSELPFRMLCRRYGADAAYTPMLHSRIFSENEKYRSMEFTTCK
Z.mays_ZM07MC04636            (82)  HWRRLGSPRLLVAPMVDNSELPFRMLCRKYGAQGAYTPMLHSRIFTETEKYRNEEFTTCK
G.max_Glyma05g20510.1         (64)  HWTKLGRPKLIVAPMVDNSELPFRMLCRKYGAQGAYTPMLHSRIFTETEKYRNEEFTTCK
G.max_Glyma17g18490.1         (64)  HWAKLGRPRFIVAPMVDNSELPFRMLCRKYGAQGAYTPMLHSRIFTETEKYRNEEFTTCK
R.communis_TA2745_3988        (84)  HWNKIGKPKLLVAPMVDNSELPFRMLCRKYGADAAYTPMLHSRIFTENEKYRTQEFTTCN
S.lycopersicum_TC206234       (88)  HWKKLGEPKLIVAPMVDNSELPFRLLCRKHGAQAAYTPMLHSRIFSENEKYRSLEFTTCK
V.vinifera_GSVIVT0001954      (85)  HWKKLGQPKLIVAPMVDNSELPFRMLCRKYGAQAAYTPMLHSRIFSENEKYRSQEFTTCK
C.vulgaris_36290              (18)  MFRSWGSPRYFVAPMVDQSELAFRMLCRRHGATAAYTPMLHSRLFLQDPNYRAEHFSTCE
V.carteri_80128               (40)  WFRSIGSPKFHVAPMVDQSELPFRLLCRRHGATCAYTPMLHARIFSQDRKYREEMLTTCS
E.huxleyi_437158               (8)  FWRSIGSPRHVCAPMVDQSEAAFRVLTRSLGVQLAYTPMLHARLMVEAPAYRAHTFDPEP
Consensus                    (121)  HWRKLGSPKLIVAPMVDNSELPFRMLCRKYGA AAYTPMLHSRIFSE EKYR  EFTTCK
PFAM PF01207                        XXXXXXXXXXXXXXXXXXXXXXXXXXXXXXXXXXXXXXXXXXXXXXXXXXXXXXXXXXXX
```

```
                                        181                                                              240
A.thaliana_AT5G67220.1      (141)  E---DRPLFVQFCANDPDTLLEAAKRVEPY--CDYVD INLGCPQRIARRGNYGAFLMDNLP
B.napus_BN06MC20455         (107)  E---DRPLFVQFCANDPDTLLEAAKRVQPY--CDYVD INLGCPQRIAKRGNYGAFLMDNLP
B.napus_TC79818             (141)  E---DRPLFVQFCANDPDTLLEAAKKVAPY--CDYVD INLGCPQRIAKRGNYGAFLMDNLP
P.patens_149014              (97)  E---DRPLLIQFCANNPDTLLAAAKLVEPF--CDYID INLGCPQRIAKRGNYGAFLMDDLP
S.moellendorffii_443602     (105)  E---DRPLFVQFCANDPEKLLAAAQLVQNC--CDYVD INLGCPQRIAKRGNYGAFLMDNLP
P.taeda_TA13257_3352        (181)  E---DRPLFVQFCANDPDILLQAAKIVEPY--CDYVD INLGCPQRIARRGYYGAFLMNNLP
O.sativa_LOC_Os06g49870.1   (140)  E---DRPLFVQFCANDPDILLQAAKMVEPY--CDYVD INFGCPQRIARRGNYGAFLMDNLP
Sacof_DuS1L                 (140)  E---DRPLFVQFCANDPDILLQAAKMVEPH--CDYVD INFGCPQRIARRGNYGAFLMDNLP
S.bicolor_Sb10g029830.1     (140)  E---DRPLFVQFCANDPDILLQAAKMVEPY--CDYVD INFGCPQRIARRGNYGAFLMDNLP
Z.mays_ZM07MC04636          (142)  E---DRPLFVQFCANDPDVLLEAAKVERF--CDYVD INFGCPQRIAKRGYYGAFLMDNLP
G.max_Glyma05g20510.1       (124)  E---DRPLFVQFCANDPDVLLAAARKVEPF--CDYVD INLGCPQRIAKRGYYGAFLMDNLP
G.max_Glyma17g18490.1       (124)  E---DRPLFVQFCANDPDILLEAARKVEPY--CDYID INLGCPQRIAKRGNYGAFLMDNLP
R.communis_TA2745_3988      (144)  E---DRPLFVQFCANDPDILLEAARRVEPY--CDYVD INLGCPQRIARRGNYGAFLMDNLP
S.lycopersicum_TC206234     (148)  E---DHPLFVQFCANDPDTLLEAARRVEPY--CDYVD INLGCPQRIARRGNYGAFLMDNLP
V.vinifera_GSVIVT00001954   (145)  E---DRPLFVQFCANDPDTLLEAAQRVEPY--CDYVD INLGCPQRIARRGNYGAFLMDNLP
C.vulgaris_36290             (78)  G---DRPLMVQFCANDPETLLAAARIVEPH--ADAID INLGCPQRIARRGRYGAFLMDDLP
V.carteri_80128             (100)  E---DRPLLVQFCAHEPQHLLAAARLVQDSGVADAID INFGCPQGIARKGRGGYGAFLDDLP
E.huxleyi_437158             (68)  DGVDRPLVAQLAGHDASVLLAAGRLVQSH--VDAVD INFGCPQGIARKGRYGAFLDEPE
Consensus                   (181)  E   DRPLFVQFCANDPD LL AAKRVEPY  CDYVD
PFAM_PF01207                       XXXXXXXXXXXXXXXXXXXXXXXXXXXXXXXXXXXXXXXXXXXXXXXXXXXXXXXXXX
Prosite_PS01136                                                             XXXXXXXXXXXXXXXXXXXXXXX
```

FIGURE 9 (conitued)

```
                              241                                                                   300
A.thaliana_AT5G67220.1  (197) LVKSLVEKLAQNLNVPVSCK RI FPNLEDTLKYAKMLEDAGCSLLAVH GR TRDEKDGKKF
B.napus_BN06MC20455     (163) LVKSLVEKLAQNLTVPVSCK IRI FPNLQDTLNYAKMLEEAGCSLLAVH GR TNEKDGKKF
B.napus_TC79818         (197) LVKSLVEKLAQNLTVPVSCK IRI FPNLQDTLNYAKMLEDAGCSLLAVH GR TRDEKDGKKF
P.patens_149014         (153) LVRSLVEKLSSGLTTPVSCK IRM FPKLEDTLAYARMIEEAGCSLLAVH GR TRDQKDGKSI
S.moellendorffii_443602 (161) LVQALVTKLVSNLDVPVSCK IRM FPSLDDTISYAKMLESSGCSLLAVH GR TREQKCSRTV
P.taeda_TA13257_3352    (237) LVESLVKNLASNLSVPVSCK IRI FPSLEDTIAYAKMLEAAGCSLLAVH GR TRDQKDGKSV
O.sativa_LOC_Os06g49870.1 (196) LVKSLVQNLSANLHVPVSCK IRI FPRLEDTLAYAKMLEEAGASLVAVH GR TRDEKDGKKF
Sacof_DuS1L             (196) LVKSLVQNLAANLHVPVSVK IRV FPRLEDTLAYAKMLEEAGASLVAVH GR TRDEKDGKKF
S.bicolor_Sb10g029830.1 (196) LVKSLVQNLAANLHVPVSVK IRV FPRLEDTLAYAKMLEEAGASLVAVH GR TRDEKDGKKF
Z.mays_ZM07MC04636      (198) LVKSLVEKLAVNLHVPVSVK IRV FPNLEDTLKYARMLEEAGCMLLAVH GR TRDEKDGKKF
G.max_Glyma05g20510.1   (180) LVKSLVEKLAVNLQVPVSCK IRL FPNLEDTLAYAKMLEEAGCSLLAVH GR TRDEKDGKKF
G.max_Glyma17g18490.1   (180) LVKSLVEKLALNLNVPVSCK IRV FPKLDDTISYARMLEEAGCSLLAVH GR TRDEKDGKKF
R.communis_TA2745_3988  (200) LVKSLVEKLANNLDVPVSCK IRV FPNLQDTLSYAKMLEDAGCSLLAVH GR TRDEKDGKKF
S.lycopersicum_TC206234 (204) LVKSLVEKLALNLNLPVSCK IRV FPNLQDTINYARMLEDAGCSLLAVH GR LREQKKSNGP
V.vinifera_GSVIVT0001954 (201) LVERIVRTCAEGLSVPVTVK IRI FPDRQKTVEYARMLERAGASLIAVH GR LREQKDNSST
C.vulgaris_36290        (134) RVESLVRVLAQNLRIPVTAK IRI FPDLAKTVAYARMVEAAGASLVAVH GR LREQNKHRSG
V.carteri_80128         (158) LAVSLVRALAEGLDVPVTAK VRL LPSVDASVALCRMQEAGASALCVH GR TKEQNKHRSG
E.huxleyi_437158        (126) LVKSLVEKLA NL VPVSCK IRVFP LEDTLAYAKMLEEAGCSLLAVH GR TRDEKDGKKF
Consensus               (241) XXXXXXXXXXXXXXXXXXXXXXXXXXXXXXXXXXXXXXXXXXXXXXXXXXXXXXXXXXXX
PFAM PF01207
```

FIGURE 9 (conitued)

```
                                    301                                                            360
A.thaliana_AT5G67220.1       (257) RADWSAIKEVKNAMRIPVLANGNVRCIEDVDNCIKETGVEGVLSAETLLENPAAFAGFRT
B.napus_BN06MC20455          (223) RADWGAIKEVREALRIPVLANGNVRCVEDVDDCIRETGVEGVLSAETLLENPAAFAGFRT
B.napus_TC79818              (257) RADWGAIKEVRNALRIPVLANGNVRCIEDVEDCIKETGVEGVLSAETLLENPAVFAGFRT
P.patens_149014              (213) RADWGVIKAVKSALRIPVVANGNIRWLEDVDECIRATGVDGVMSAESLLENPALFAGYRM
S.moellendorffii_443602      (221) RADWEVIRAVKVRIPVLANGNIRWLEDAERCIQETGVDGVLSAESLLENPALFAGYRT
P.taeda_TA13257_3352         (297) RADWAVINAVKKAVRIPVLANGNIRYLEDVYDCLRETGADGVLSAESILENPALFAGYRL
O.sativa_LOC_Os06g49870.1    (256) RADWDAIKAVKDALRIPVLANGNIRHLDDVKDCLEHTGADGVLSAETLLENPALFAGFRT
Sacof_DuS1L                  (256) RADWDAIKAVKDALRVPVLANGNIRHMEDVKNCLEHTGADGVLSAETLLENPALFAGFRT
S.bicolor_Sb10g029830.1      (256) RADWDAIKAVKDALRVPVLANGNIRHMEDVKNCLEHTGADGVLSAETLLENPALFAGFRT
Z.mays_ZM07MC04636           (258) RADWDAIKAVKDALRVPVLANGNIRHMEDVKNCLEHTGADGVLSAETLLENPAVFAGFRT
G.max_Glyma05g20510.1        (240) RADWKAIRAVKNAVRIPVLANGNIRHIDDVRDCLEETGVEGVLSAETLLENPALFAGFRT
G.max_Glyma17g18490.1        (240) RADWNAIRAVKNAVRIPVLANGNIRHMDDVRDCLEETGVEGVLSAETLLENPALFDGFRT
R.communis_TA2745_3988       (260) RADWKAIKAVRNAVKIPLLANGNVRHMDDVRNCLEETGADGVLSAESLLENPALFAGYRL
S.lycopersicum_TC206234      (264) RANWEAIKAVRDVVRIPVLANGDIRHMDDVHNCLEKTGADGVLSAESLLENPALFAGYRT
V.vinifera_GSVIVT00001954    (261) RADWNAIKAVKNAVSIPVLANGDIRHMDDVQRCLEETGADGVLSAESLLENPALFAGFQT
C.vulgaris_36290             (194) DADWDAIKAVVEAVGVPVLANGNIRTLADVHACMAYTGAVGVLSAESLLEDPALFSP--R
V.carteri_80128              (218) RADWDAIRAVKAALSVPVLANGNIRHLGDVGACLSYTGADGVLSAESLLADPALFDVPAR
E.huxleyi_437158             (186) PADWAAIARIVEALDIPVIANGGIATADDVAECLARTGAAAVMSSEALLENPALFCANVD
Consensus                    (301) RADW AIKAVK ALRIPVLANGNIRHMEDV   CLEETGADGVLSAETLLENPALFAGFRT
PFAM PF01207                       XXXXXXXXXXXXXXXXXXXXXXXXXXXXXXXXXXXXXXXXXXXXXXXXXXXXXXXXXXXX
```

FIGURE 9 (conitued)

FIGURE 9 (conitued)

```
                                          361                                                                              420
A.thaliana_AT5G67220.1     (317) AEWAKDNEE------------------------EGFVDGGLDQGDLVVEYLKLCEKHPVPWR-MIRSH
B.napus_BN06MC20455        (283) AAWAKE---------------------------EGYVDGGLDQGDLVVEYLKLCEKHPVPWR-MIRSH
B.napus_TC79818            (317) AEWAKGSEEE-----------------------EGYVDGGLDQGDLVVEYLKLCEKHPVPWR-MIRSH
P.patens_149014            (273) KPLDSSAAEP-----------------------DDHDKKYSLNEPTLVLEYLDFCDKYPVPAR-MIRAH
S.moellendorffii_443602    (281) FKPSDSEDEE-----------------------QGSSKLMIDPVTLLMEYLDQCEKYPAPDK-CIRAH
P.taeda_TA13257_3352       (357) MADWEDNSSSQAEEVLEKYERVKHTEHELKHPFNQATLVLEYFDLCEKYPVPWR-MVRAH
O.sativa_LOC_Os06g49870.1  (316) KEWKENG--------------------------DEDEASGLDQADLVIEYLKLCEQYPVPWR-MVRSH
Sacof_DuSiL                (316) KEWKEDG--------------------------DENGDSGLDQADLVIEYLKLCEQYPVPWR-MVRSH
S.bicolor_Sb10g029830.1    (316) KEWKEDS--------------------------DENGDSGLDQADLVIEYLKLCEQYPVPWR-MVRSH
Z.mays_ZM07MC04636         (318) KEWKEDG--------------------------DENGDGGLDQADLVIEYLKLCEKYPVPWR-MVRSH
G.max_Glyma05g20510.1      (300) AEWVSESEG------------------------TNVDGKLDQADLLIEYLKLCEKYPVPWR-MIRSH
G.max_Glyma17g18490.1      (300) AEWVSESEG------------------------TNLDGKLDQADLLIEYLKLCEEYPVPWR-MIRAH
R.communis_TA2745_3988     (320) AEWVVGDEE------------------------STRDGKLDQADLLVEYLKLCEEYPVPWR-MIRSH
S.lycopersicum_TC206234    (324) AQWGLSTAG------------------------IKEDGKLDQAQLVVDYLKLCERHPVPWR-MIRSH
V.vinifera_GSVIVT0001954   (321) AEW------------------------------A--LDQANLLVEYLKLCEEYPVPWR-MIRSH
C.vulgaris_36290           (252) RLQPGGAFGG-----------------------AQGAHLLLEYLDLVDAHPCPMR-MVTGH
V.carteri_80128            (278) ASVAVGDVSGR----------------------GRWYSAPPLERLSLAAQYMDLVRAHPVPLR-MVRGH
E.huxleyi_437158           (246) PDSG---------------------------------AYLDQPELARRYLRVCRQLPPPTLGHVRSH
Consensus                  (361) AEW                              D    DG LDQADLVIEYLKLCEKYPVPWR MIRSH
PFAM PF01207                     XXXXXXXXXXXXXXXXXXXXXXXXXXXXXXXXXXXXXXXXXXXXXXXXXXXXXXXXXXXXXXXXXXX
```

```
                                                421                                                           480
A.thaliana_AT5G67220.1    (360) VHKMLGEWFRIHPQVREQLNAQN------ILTFEFLYGLVDQLRELGGRVPLYKKKIDTL
B.napus_BN06MC20455       (323) VHKMLGDWFRVHPQVREEFNAQN------ILTFEFLYGLVDQLKELGGRVPLYKKRKID--
B.napus_TC79818           (361) VHKMLGDWFRVHPQVREQLNAQN------ILTFEFLYGLVDQLKELGGRVPLYKKRKID--
P.patens_149014           (318) VHRMLGPWFRQYPHLREELNKQF------SITTEWLKGLVHRLLAEHEASEILRQTGALDQ
S.moellendorffii_443602   (325) VHRLLGEWFRVHPDLREKLNREH------KVDSTWLRDLGREMLERMRPKLGEVAEEASD-
P.taeda_TA13257_3352      (416) VHRMLGDWFRIYPDLRQELNKQS------KLTFEWLRDMVHQLMERDTKLVLRPSTPCEKL
O.sativa_LOC_Os06g49870.1 (357) VHKMLGDWFRVHPQVREELNAQS------KLTFEWLHDMVKRLKDLGGGIPLYRNNNALQT
Sacof_DuS1L               (357) VHKMLGDWFRVHPEVREELNKQN------KLTFEWLHDMVLRLKELGGRVPLYRKESALGT
S.bicolor_Sb10g029830.1   (357) VHKMLGDWFRVHPEVREELNKQN------KLTFEWLHDMVMRLKELGGRVPLYRKETALET
Z.mays_ZM07MC04636        (359) VHKMLGDWFRVHPEVREELNKQN------KLTFEWLHDMVMRLKDLGGRVPLYRKETALG-
G.max_Glyma05g20510.1     (342) VHKLLGDWFSLQPHIREELNKQS------KLTFEFLYDMVDRLRATGIRIPLYKDTQVELT
G.max_Glyma17g18490.1     (342) VHKLLGDWFSLQPHIREELNKQS------KLTFEFLYDMVDRLRSTGTRIPLYKNTEVEHT
R.communis_TA2745_3988    (362) VHKMLGDWFRIEPSVREDFNQQS------RLTFEFLYGLVNRLRELGVSVPLYVKETQEEA
S.lycopersicum_TC206234   (366) VHKMLGEWFRIQPQVRDDLNSQS------QLTFEFLYGLVNRLRELGVSVPLYVKETQEEA
V.vinifera_GSVIVT0001954  (352) VHKLLGEWFRIQPQVRDDLNSQS------KLTFEFLYNMVDQLRELGVRIPLYTKDTPAGR
C.vulgaris_36290          (289) AFRMLGAWLSEFTDLRDRLNQQHKEFGVEDIRELAQDVISRIEGLGRDYPVPKLSERALA
V.carteri_80128           (324) VHKMVGDWLAEHTDLRDNINRLP------PTIQLFCQVRVRVCGGVKEVCVCVYVSRFAND
E.huxleyi_437158          (280) LFKLLHAPLRHQPLLREDLLEAT------SLDDVEPVVERLAACSHHQPAFHTPRFDAA
Consensus                 (421) VHKMLGDWFRVHP VREELNKQ       KLTFEFLYDMV RLKELG RVPLYKK
PFAM PF01207                    XXXXXXXXXXXXXXXXXXXXXXXXXXXXXXXXXXXXXXXXXXXXXXXXXXXXXXXXXX
```

FIGURE 9 (conitued)

```
A.thaliana_AT5G67220.1    (415)  TPQDSPQRV-----------------------------------------------------
B.napus_BN06MC20455       (376)  TPQESPQRV-----------------------------------------------------
B.napus_TC79818           (414)  TLQESPQRV-----------------------------------------------------
P.patens_149014           (373)  VRENGVAQPIIIDALSDSSALQTANAVVS---------------------------------
S.moellendorffii_443602   (379)  --------------------------------------------------------------
P.taeda_TA13257_3352      (471)  IYKASSC-------------------------------------------------------
O.sativa_LOC_Os06g49870.1 (412)  TSNGLAASNA----------------------------------------------------
Sacof_DuS1L               (412)  TLDGLASSNA----------------------------------------------------
S.bicolor_Sb10g029830.1   (412)  TLDGLASSNA----------------------------------------------------
Z.mays_ZM07MC04636        (413)  --QTLASSNA----------------------------------------------------
G.max_Glyma05g20510.1     (397)  AGSYPD--------------------------------------------------------
G.max_Glyma17g18490.1     (397)  AGSYPD--------------------------------------------------------
R.communis_TA2745_3988    (417)  TGVAANGLTN----------------------------------------------------
S.lycopersicum_TC206234   (421)  ASPNGDGA------------------------------------------------------
V.vinifera_GSVIVT0001954  (407)  TS-NGIAT------------------------------------------------------
C.vulgaris_36290          (349)  RMEREAAMAAAIAEQNREESSLQRIAANRAESLGNVEARRVLQAAA----------------
V.carteri_80128           (379)  PVLSRHACGGHIHCVTHCRLARCSVAPCPLTSCSFLLLLIEQC-------------------
E.huxleyi_437158          (333)  ASWYWRHRTAAVSADGELGETRGAGGASSPESRSRAELEAAALERRDRRRREKKRRRRQR
Consensus                 (481)
```

481                                                         540

FIGURE 9 (conitued)

```
A.thaliana_AT5G67220.1      (424) ----------------
B.napus_BN06MC20455         (385) ----------------
B.napus_TC79818             (423) ----------------
P.patens_149014             (402) ----------------
S.moellendorffii_443602     (379) ----------------
P.taeda_TA13257_3352        (478) ----------------
O.sativa_LOC_Os06g49870.1   (422) ----------------
Sacof_DuSiL                 (422) ----------------
S.bicolor_Sb10g029830.1     (422) ----------------
Z.mays_ZM07MC04636          (421) ----------------
G.max_Glyma05g20510.1       (403) ----------------
G.max_Glyma17g18490.1       (403) ----------------
R.communis_TA2745_3988      (427) ----------------
S.lycopersicum_TC2062234    (429) ----------------
V.vinifera_GSVIVT00001954   (414) ----------------
C.vulgaris_36290            (395) ----------------
V.carteri_80128             (423) ----------------
E.huxleyi_437158            (393) GAASVAAAPAVAVL-
Consensus                   (541)
```

FIGURE 9 (conitued)

MAKSRPPKRILESYTIKGSDKVIKPGDCVLMRA

<div align="right">BAH domain</div>

SDTSKPPYVARVEAIEAAGSRGTNVRVRVRWYY

<div align="center">BAH domain</div>

RPEESMGGRRPFHGAKEVFLSDHYDVQSADTIE

<div align="center">BAH domain</div>

GKCNVHSFRSYTKLDSVNAEDFFCRFEYKSATG

<div align="center">BAH domain</div>

SFVPDRIAVF*CKCEMP*YNPDDLMIQCEECSDWF

BAH domain          PHD domain

HPSCIGMTIKDAKKLEHFFCQSCTAENGKMAEN

<div align="center">PHD domain</div>

SHEATAQSEEKQVESKRRRR

FIGURE 11 multiple sequence alignment

```
O.sativa_Os07g0186400#1              ----------MAKSRPPKRILESYTIKGSDKVIKPGDCVLMRASDTSKPPY
T____M____---_29382_---4312_116      ----------MAKSRPPKRILESYTIKGSDKVIKPGDCVLMRASDTSKPPN
O.sativa_AK061201#1                  ----------MAKSRPPKRILESYTIKGSDKVIKPGDCVLMRASDTSKPPY
Z.mays_TA12947_4577999#1             ----------MAGKSRPPKRILESYTIKGSDRVIKPGDCVLMRASDASKPPY
Z.mays_ZM07MC24083_BFb0146O24@       ----------MAGKSRPPKRILESYTIKGSDRVIKPGDCVLMRASDASKPPY
H.vulgare_TA40508_4513#1             ----------MAKTRPPKRILESYTIKGSDKVIKPGDCVLMRSADTSKPPY
H.vulgare_TA35269_4513#1             ------MSKTPGKSPRTPRRTLESYTIKGSDGVIRPGDSVLMKAPDSSKPPY
O.sativa_Os03g0799600#1              ----------MAKTRQPQKRVLESFTIKGPDGVIKPGDTVLMMAPDSSKKPY
A.thaliana_AT4G39100.1#1             ----------MPKQKAPRKQLKSYKLKHINKSIQEGDAVLMRSSEPGKPSY
T____M____---_2176_---0490_46_8      ----------MPKQKAPRKQLKSYKLKHINKSIQEGDAVLMRSSEPGKPSY
B.napus_BN06MC06825_4249423406       ----------MPKQKAQKKQLKSYKLKHINRTIQEGDAVLMRSSEPGKPSY
P.trichocarpa_scaff_IV.1226#1        ----------MAKAKAPRRTLDSYTVKPINKTVKPGDCVLMRPSDPSKPSY
S.lycopersicum_TA42220_4081#1        ----------MAKTRTNRRTLDSYTVKSINKTVRAGDCVLMRASESSKPSY
A.thaliana_AT4G22140.1#1             -MAKTRPGVASKIKTGRKELDSYTIKGTNKVVRAGDCVLMRPSDAGKPPY
A.thaliana_AT4G22140.2#1             -MAKTRPGVASKIKTGRKELDSYTIKGTNKVVRAGDCVLMRPSDAGKPPY
A.thaliana_AT4G04260.1#1             --------------------------------------MRPSDAGKAPY
P.trichocarpa_scaff_XI.104#1         MAKTRPGGIISKPKTGKRDLESYTIRGTTKVVRAGDCVLMRPSDTGRPSY
P.trichocarpa_scaff_166.34#1         MAKTRPGGLISKPKTGKRDLDSYTIRGTTKVVRVGDCVMMRPSDTGRPSY
H.vulgare_TA42493_4513#1             ----------MAKTKQGKRDIDSYTIRGTTKVVRVGDCVLMRPSDTDNAPY
T.aestivum_c54968390@13747#1         ----------MAKTKQGKRDIDSYTIRGTTKVVRVGDCVLMRPSDTDNAPY
T____M____---_14367_---4367_137      ----------MAKTKQGKRDIDSYTIRGTTKVVRVGDCVLMRPSDTDNAPY
T.aestivum_TA54637_4565#1            ----------MAKTKQGKRDIDSYTIRGTTKVVRVGDCVLMRPSDTDNAPY
H.vulgare_BF623189#1                 ----------MAKTKQGKRDIDSYTIRGTTKVVRVGDCVLMRPSDTDNAPY
O.sativa_Os09g0386500#1              ----------MAKTKQGKKDVESYTIKGTTKIVRVGDCVLMRASDTEKAPY
Z.mays_TA19459_4577999#1             ----------MAKTKQGKRDVDAYTIKGTNKVVRVGDCVLMRPADTDNPPY
Z.mays_ZM07MC24174_BFb0045F09@       ----------MAKTKQGKRDVDAYTIKGTNKVVRVGDCVLMRPADTDNPPY
O.sativa_Os08g0421900#1              ----------MAKTKQGKRDVDSYTISGTNKVVRVGDCVLMRPVDSDNQPY
P.trichocarpa_scaff_II.2065#1        ----------MAKTKPGKKDLDSYTIKGTNKVVRPGDCVLMRPSDTDKLPY
S.lycopersicum_TA40478_4081#1        ----------MAKTKPGKKDLDSYSIKGTNKVVRPGDCVLMRPSDSDKPPY
P.trichocarpa_scaff_XIV.1045#1       ----------MAKTKPGKKDLDSYTIKGTNKVVRPGDCVLMRPSDTDKLPY
P.trichocarpa_scaff_1247.1#1         ----------MAKTKPGKKDLDSYTIKGTNKVVRPGDCVLMRPSDTDKLPY
P.patens_149469#1                    ----------MAKSKAAKRSLDSYTVKGTNKVVKVGDTVLMRGQDPEKPPY
P.patens_108696#1                    ----------MAKSKGAKKALDSYTVKGTQKVVKVGDCVLMRGQDPDKPPY
P.patens_153027#1                    ----------MAKPKNGKKTLDSCVIKGTRKIVKVGDTVLMRSEDADKPPY
P.patens_59496#1                     ----------MAKPKNGKKTLDSCVIKGTRKIVKVGDTVLMRSEDPDKPPY
P.patens_213413#1                    ----------MTKKRTTKSRLDYYRIANTQKIIKPGDTVTLRPPDLTTPPY
T.aestivum_CK201479#1                ------MSKTPGKTPRTPRRILESYTIKGSDGVIRPGDSVLMKAPDTSNSPY
L.usitatissimum_LU04MC11049_62       --------------MSSFGFADSVPGTPSYGLGGKGPFSFADSVPGTPAYD
```

FIGURE 12

| | |
|---|---|
| O.sativa_Os07g0186400#1 | VARVEAIEAAGSRGTNVRVRVRWYYRPEESMGGRRPFHGAKEVFLSDHYD |
| T____M____---_29382_---4312_116 | VARVEAIEAAGSRGTNVRVRVRWYYRPEESMGGRRPFHGAKEVFLSDHYD |
| O.sativa_AK061201#1 | VARVEAIEAAGSRGTNVRVRVRWYYRPEESMGGRRPFHGAKEVFLSDHYD |
| Z.mays_TA12947_4577999#1 | VARVEAIEAAGSRGTNVRVRVRWYYRPEESIGGRRPFHGSKEVFLSDHYD |
| Z.mays_ZM07MC24083_BFb0146O24@ | VARVEAIEAAGSRGTNVRVRVRWYYRPEESIGGRRPFHGSKEVFLSDHYD |
| H.vulgare_TA40508_4513#1 | VAKVESIEAAGSRGTNVRVRVRWYYRPEESIGGRRPFHGSKEVFLSDHYD |
| H.vulgare_TA35269_4513#1 | VAKIEEIEAAGPRGANVKVKVRWYYRPEESIGGRRPFHGEKEVFLSDHQD |
| O.sativa_Os03g0799600#1 | VARVEEIEATGPQASQVKIKVRWYYRPEESIGGRRPFHGSKEVFLSDHYD |
| A.thaliana_AT4G39100.1#1 | VARVEAIET-DARGSHAKVRVRWYYRPEESIGGRRQFHGAKEVFLSDHFD |
| T____M____---_2176_---0490_46_8 | VARVEAIET-DARGSHAKVRVRWYYRPEESIGGRRQFHGAKEVFLSDHFD |
| B.napus_BN06MC06825_42494234@6 | VARVEAIEATDARGSNARVRVRWYYRPEESMGGRRQFHGAKEVFLSDHFD |
| P.trichocarpa_scaff_IV.1226#1 | VAKIERIES-DGRGPNVRVRVRWYYRPEESIGGRRQFHGSKEVFLSDHYD |
| S.lycopersicum_TA42220_4081#1 | VARVEKIES-DNRGGNVRVHVRWYYRPEESIGGRRQFHGSKELFMSDHRD |
| A.thaliana_AT4G22140.1#1 | VARVEKIEADARNN--VKVHCRWYYRPEESLGGRRQFHGAKELFLSDHFD |
| A.thaliana_AT4G22140.2#1 | VARVEKIEADARNN--VKVHCRWYYRPEESLGGRRQFHGAKELFLSDHFD |
| A.thaliana_AT4G04260.1#1 | VARVEKIEADARNN--VKVHCRWYYCPEESHCGRRQLHGAKELFLSDHFD |
| P.trichocarpa_scaff_XI.104#1 | VAKIEAIEADSRNN--VKVRVRWYYRPEESLGGRRQFHGAKELFLSDHYD |
| P.trichocarpa_scaff_166.34#1 | VARIEGMEADSRNN--VKVRVRWYYRPEESLGGRRQFHGAKELFLSDHYD |
| H.vulgare_TA42493_4513#1 | VARVESLESDGRGS--VRVRVRWYYRPEESKGGRRQFHGAKELFLSDHFD |
| T.aestivum_c54968390@13747#1 | VARVESLESNGRGS--VRVRVRWYYRPEESKGGRRQFHGAKELFLSDHFD |
| T____M____---_14367_---4367_137 | VARVESLESDGRGS--VRVRVRWYYRPEESKGGRRQFHGAKELFLSDHFD |
| T.aestivum_TA54637_4565#1 | VARVESLESDGRGS---VRVRVRWYYRPEESKGGRRQFHGAKELFLSDHFD |
| H.vulgare_BF623189#1 | VARVESLESDGRGS--VRVRVRWYYRPEESKGGRRQFHGAKELFLSDHFD |
| O.sativa_Os09g0386500#1 | VGRVERLETDGRGS--VRVRVRWYYRPEESGGGRRQFHGAKELFLSDHFD |
| Z.mays_TA19459_4577999#1 | VARVERMESDGRGS--VRVRVRWYYRPEEAKGGRRPFHGAKELFLSDHFD |
| Z.mays_ZM07MC24174_BFb0045F09@ | VARVERMESDGRGS--VRVRVRWYYRPEEAKGGRRPFHGAKELFLSDHFD |
| O.sativa_Os08g0421900#1 | VARVEKMELDGRGS--VRVRVRWYYRPEESKGGRRQFHGAKELFLSDHFD |
| P.trichocarpa_scaff_II.2065#1 | VALVEKIEADHRNN--VKVRVRWYYRPEESIGGRRQFHGAKELFLSDHHD |
| S.lycopersicum_TA40478_4081#1 | VAKVDKIEADHRNN--VKVRVQWYYRPEESVGGRRQFHGAKELFLSDHYD |
| P.trichocarpa_scaff_XIV.1045#1 | VARIEKIEADHRNN--VKVRVRWYYRPEESIGGRRQFHGAKELFLSDHYD |
| P.trichocarpa_scaff_1247.1#1 | VALVEKIEADHRNN--VKVRVRWYYRPEESIGGRRQFHGAKELFLSDHHD |
| P.patens_149469#1 | VAKIEKIEADGRNNSNVKVRCRWYYRPEESMGGRRQFHGTKELFLSDHYD |
| P.patens_108696#1 | VAKIEKIEADNRNN--TKVRVRWYYRPEESMGGRRQFHGSKELFLSDHYD |
| P.patens_153027#1 | IAKVEKIEGDSRGN--VKVRVRWYYRPEESMSGRKQFHGQKEVFLSDHYD |
| P.patens_59496#1 | IAKVENIEGDSRGN--VKVQVRWYYRPEESMSGRKQFHGQKEVFLSDHYD |
| P.patens_213413#1 | VARIELIELDAAEK--ITLKVRWYYRPEESAGGRRQFHGSKELFLSDHYD |
| T.aestivum_CK201479#1 | VAMIEEILAVGPRGAHVQVKVRWCYRTG···················GVHWW |
| L.usitatissimum_LU04MC11049_62 | FGNSRRLSEGSDDHSFDNFSRFDSFNLNESSSSSFPSSGPSLARFDSVRS |
| | .. : . : . |

FIGURE 12 (continued)

| | |
|---|---|
| O.sativa_Os07g0186400#1 | VQSADTIEGKCNVHSFRSYTKLDSVNAEDFFCRFEYKSATGSFVPDRIAV |
| T___M___---_29382_---4312_116 | VQSADTIEGKCNVHSFRSYTKLDSVNAEDFFCRFEYKSATGSFVPDRIAV |
| O.sativa_AK061201#1 | VQSADTIEGKCNVHSFRSYTKLDSVNAEDFFCRFEYKSATGSFVPDRIAV |
| Z.mays_TA12947_4577999#1 | VQSADTIEGKCNVHSFRSYTKLDSVNAEDFFCRFEYKSATGSFVPDRIAV |
| Z.mays_ZM07MC24083_BFb0146024@ | VQSADTIEGKCNVHSFRSYTKLDSVNAEDFFCRFEYKSATGSFVPDRIAV |
| H.vulgare_TA40508_4513#1 | VQSADTIEGKCNVHSFRSYTKLDSVNAEDFFCRFDYKSASGSFVPDRIAV |
| H.vulgare_TA35269_4513#1 | VQSADTIECKCNVYSFRDYTKLAAVNPEDYFCRFEYKSITGSFVPDRIAV |
| O.sativa_Os03g0799600#1 | SQSADTIEGKCYVHTFRDYTKLRSVSAEDFFCRFEYKSATGSFVPDRIAV |
| A.thaliana_AT4G39100.1#1 | FQSADTIEGKCKVHSFSSYTKLDSVGNDDFFCRFEYNSTTGAFDPDRVTV |
| T___M___---_2176_---0490_46_8 | FQSADTIEGKCKVHSFSSYTKLDSVGNDDFFCRFEYNSTTGAFDPDRVTV |
| B.napus_BN06MC06825_42494234@6 | LQSADTIEGKCKVHSFSSYTKLSSVGNDDFFCRFEYNSATGAFIPDRVAV |
| P.trichocarpa_scaff_IV.1226#1 | TQSADTIEGKCMVHSFKNYTKLDAVGNDDFFCRFEYNSSTGAFNPDRVAV |
| S.lycopersicum_TA42220_4081#1 | IQSADTIEGKCTVHTFKSYTKLDAVGNEDFFCRFDYNSSTGAFNPDRVAV |
| A.thaliana_AT4G22140.1#1 | VQSAHTIEGKCIVHTFKNYTRLENVGAEDYYCRFEYKAATGAFTPDRVAV |
| A.thaliana_AT4G22140.2#1 | VQSAHTIEGKCIVHTFKNYTRLENVGAEDYYCRFEYKAATGAFTPDRVAV |
| A.thaliana_AT4G04260.1#1 | VQSAHTIEGKCIVHTFKNYTRLENVGVEDYYCIFDYKAATGAFTPDRVAV |
| P.trichocarpa_scaff_XI.104#1 | VQSAHTIEGKCIVHSFKNYTKLENVGAEDYYCRFEYKAATGGFTPDRVAV |
| P.trichocarpa_scaff_166.34#1 | VQSAHTIEGKCIVHSFKNYTKLENVGAEDYYCRFEYKAATGGFTPDRVAV |
| H.vulgare_TA42493_4513#1 | TQSAHTIEGKCIVHSFKNYTKLDNVGPEDFFCRFEYKAATGAFTPDRVAV |
| T.aestivum_c54968390@13747#1 | TQSAHTIEGKCIVHSFKNYTKLDNVGPEDFFCRFEYKAATGAFTPDRVAV |
| T___M___---_14367_---4367_137 | TQSAHTIEGKCIVHSFKNYTKLDNVGPEDFFCRFEYKAATGAFTPDRVAV |
| T.aestivum_TA54637_4565#1 | TQSAHTIEGKCIVHSFKNYTKLDNVGPEDFFCRFEYKAATGAFTPDRVAV |
| H.vulgare_BF623189#1 | TQSAHTIEGKCIGHSFKNYTKLDNVGPEDLFCRFECKAVTGAYTPNRVDS |
| O.sativa_Os09g0386500#1 | TQSAHTIEGKCIVHSFKNYTKLDNVGPEDFFCRFEYKAATGAFTPDRVAV |
| Z.mays_TA19459_4577999#1 | TQSAHTIEGKCIVHSFKSYTKLDNVGPEDFYCRFDYKAATGAFTPDRVAV |
| Z.mays_ZM07MC24174_BFb0045F09@ | TQSAHTIEGKCIVHSFKSYTKLDNVGPEDFYCRFDYKAATGAFTPDRVAV |
| O.sativa_Os08g0421900#1 | MQSANTIEGKCVVHSFKNYTKLDNVGPEDFFCRFEYKAATGAFTPDRVAV |
| P.trichocarpa_scaff_II.2065#1 | MQSAHTIEGKCTVHSFKNYSKLENVGAEDYFCRFEYKASTGGFTPDRVAV |
| S.lycopersicum_TA40478_4081#1 | FQSAHTIEGKCTVHSFKNYTKLENVGPEDYFCRFDYKAATGGFTPDRVAV |
| P.trichocarpa_scaff_XIV.1045#1 | VQSAHTIEGKCTVHSFKNYTKLENVGAEDYFCRFEYKASTGGFTPDRVAV |
| P.trichocarpa_scaff_1247.1#1 | MQSAHTIEGKCTVHSFKNYSKLENVGAEDYFCRFEYKASTGGFTPDRVAV |
| P.patens_149469#1 | IQSADTIEGKCTVHTFKNYTKLESVGAEDYFCRFEYKASTGGFTPDRVAV |
| P.patens_108696#1 | IQSADTIEGKCIVHTFKNYTKLDSVGTEDYFCRFEYKASTGGFTPDRVAV |
| P.patens_153027#1 | VQSADTIEGKCIVHSFKNYTKLETVSAEDYFCRFEYKATTGGFTPDRVAV |
| P.patens_59496#1 | VQSADTIEGKCIVHSFKNYTKLEAVSAEDYFCRFEYKATTGGFTPDRVAV |
| P.patens_213413#1 | VCSPEAVENKCTIHTFKDYTRLEDVGTDDYFCRFDYNARSGTFSPDRVAV |
| T.aestivum_CK201479#1 | AHAIPCAKRRCFSLTTKMCRVLTSYTG----------TASSTASGTTPSL |
| L.usitatissimum_LU04MC11049_62 | TRESEQGFGAPSRFDSFRESGDSDLGQGFSRFDSFRDSDQSHVLPSFDSF |
| | : . |

FIGURE 12 (continued)

| | |
|---|---|
| O.sativa_Os07g0186400#1 | FCKCEMPYNPDDLMIQCEECSDWFHPSCIGMTIKDAKKLEHFFCQSCTAE |
| T____M____---_29382_---4312_116 | FCKCEMPYNPDDLMIQCEECSDWFHPSCIGMTIKDAKKLEHFFCQSCTAE |
| O.sativa_AK061201#1 | FCKCEMPYNPDDLMIQCEECSDWFHPSCIGMTIKDAKKLEHFFCQSCTAE |
| Z.mays_TA12947_4577999#1 | FCKCEMPYNPDDLMIQCEECSDWFHPACIGMTIKEAKKLEHFFCQTCTAE |
| Z.mays_ZM07MC24083_BFb0146O24@ | FCKCEMPYNPDDLMIQCEECSDWFHPACIGMTIKEAKKLEHFFCQTCTAE |
| H.vulgare_TA40508_4513#1 | FCKCEMPYNPDDLMIQCEECSDWFHPSCIGMTIKEAKKREHFFCQSCTDE |
| H.vulgare_TA35269_4513#1 | FCKCEMPYNPDDLMIQCEECSDWFHPACIGKTIKEAKKLENFTCEGCVAE |
| O.sativa_Os03g0799600#1 | FCKCEMPYNPDNLMIQCEDCSDWFHPSCVEITIKEAKKLEHFYCKSCIAE |
| A.thaliana_AT4G39100.1#1 | FCKCEMPYNPDDLMVQCEECSEWFHPSCIGTTIEEAKKPDNFYCEECSPQ |
| T____M____---_2176_---0490_46_8 | FCKCEMPYNPDDLMVQCEECSEWFHPSCIGTTIEEAKKPDNFYCEECSPQ |
| B.napus_BN06MC06825_42494234@6 | FCKCEMPYNPDDLMVQCEECSEWFHPSCIGTTIEAAKKLDHFYCEECSPE |
| P.trichocarpa_scaff_IV.1226#1 | YCKCEMPYNPDDLMVQCEGCSDWFHPACIEMSAEEAKRLDHFFCENCSSE |
| S.lycopersicum_TA42220_4081#1 | YCKCEMPYNPDDLMVQCEGCSDWFHPTCIDMTPEEAKRLDHFFCQNCSSE |
| A.thaliana_AT4G22140.1#1 | YCKCEMPYNPDDLMVQCEGCKDWYHPACVGMTIEEAKKLDHFVCAECSSD |
| A.thaliana_AT4G22140.2#1 | YCKCEMPYNPDDLMVQCEGCKDWYHPACVGMTIEEAKKLDHFVCAECSSD |
| A.thaliana_AT4G04260.1#1 | YYKCEMPYN-SDELMELLLCHYRVHLACVGVTIEEAKKLEHFVCVECSSD |
| P.trichocarpa_scaff_XI.104#1 | YCKCEMPYNPDDLMVQCEGCKDWYHPACVDMTIEEAKKLDHFMCSECASD |
| P.trichocarpa_scaff_166.34#1 | YCKCEMPYNPDDLMVQCEGCKDWYHPACVDMTIEEAKKLDHFVCSECASD |
| H.vulgare_TA42493_4513#1 | YCKCEMPYNPDDLMVQCEGCKDWFHPTCMGMTIEQAKKLDTFLCADCAKE |
| T.aestivum_c54968390@13747#1 | YCKCEMPYNPDDLMVQCEGCKDWFHPTCMGMTIEQAKKLDTFLCADCAKE |
| T____M____---_14367_---4367_137 | YCKCEMPYNPDDLMVQCEGCKDWFHPTCMGMTIEQAKKLDTFLCADCAKE |
| T.aestivum_TA54637_4565#1 | YCKCEMPYNPDDLMVQCEGCKDWFHPTCMGMTIEQAKKLDTFLCADCAKE |
| H.vulgare_BF623189#1 | VCKCYMPYNPNDQMEQSVGMLTPI-------------------------- |
| O.sativa_Os09g0386500#1 | YCKCEMPYNPDDLMVQCEGCKDWFHPSCMGMTIEQAKKLDHFLCADCVKE |
| Z.mays_TA19459_4577999#1 | YCKCEMPYNPDDLMVQCEGCKDWFHPSCMGMTIEQAKKIDHYMCSDCAKE |
| Z.mays_ZM07MC24174_BFb0045F09@ | YCKCEMPYNPDDLMVQCEGCKDWFHPSCMGMTIEQAKKIDHYMCSDCAKE |
| O.sativa_Os08g0421900#1 | YCKCEMPYNPDDLMVQCDDCKDWFHPSCMSMTIEQAKKLDHFVCSDCVKE |
| P.trichocarpa_scaff_II.2065#1 | YCKCEMPYNPDDLMVQCEGCKDW--------------------------- |
| S.lycopersicum_TA40478_4081#1 | YCKCEMPYNPDDLMVQCEGCKDWFHPICMGMTIDEAKKLDPFLWSDCSSE |
| P.trichocarpa_scaff_XIV.1045#1 | YCKCEMPYNPDDLMVQCEGCKDWFHPSCMGMTIEEAKKSDHFLCSDCSSD |
| P.trichocarpa_scaff_1247.1#1 | YCKCEMPYNPDDLMVQCEGCKDW--------------------------- |
| P.patens_149469#1 | YCKCEMPYNPDDLMVQCEICKDWFHPSCMSMTPDQVKKMEKFFCPDCTSQ |
| P.patens_108696#1 | YCKCEMPYNPDDLMVQCETCKDWFHPSCMSFTPDQVKRMEKFVCPDCSLP |
| P.patens_153027#1 | YCKCEMPYNPDHVMLECNSCKDWFHRHCVGLSEEQVKHVDRYICPTCAPE |
| P.patens_59496#1 | YCKCEMPYNPDHVMLECNSCKDWFHRHCVGLSEEQVKHVDRYICPGCAPE |
| P.patens_213413#1 | YCKCEMPYNPDDLMVQCENCKDWFHPKCVMLSSEDIKNVKNFHCPDCINS |
| T.aestivum_CK201479#1 | LVSVLMDYFGRFVFHVNHRPLCTVSGCCVLVILNWLVTLADLFIPLCGNV |
| L.usitatissimum_LU04MC11049_62 | DNGQGFPSRFDSFRDSGDFDHGRGITRFDSFGGQSSGFDYEHGSKDSLNK |
| | : |

FIGURE 12 (continued)

```
O.sativa_Os07g0186400#1                      NG----KMAENSHEATAQSEEKQVESKRRRR--------------------
T    M    ---29382 ---4312_116               NG----KMAENSHEATAQSEEKQVESKRRRR--------------------
O.sativa_AK061201#1                          NG----KMAENSHEATAQSEEKQVESKRRRR--------------------
Z.mays_TA12947_4577999#1                     NG----KMVENSHEATAQSEEKPVESKRRRR--------------------
Z.mays_ZM07MC24083_BFb0146O24@                NG----KMVENSHEATAQSEEKPVESKRRRR--------------------
H.vulgare_TA40508_4513#1                     NG----KTTENSHEATSQSEEKPVESKRRRR--------------------
H.vulgare_TA35269_4513#1                     NGNANGVKNENSHESTGESDEKQVQSKRRRR--------------------
O.sativa_Os03g0799600#1                      NG----KDLQKSNGATVQSEEKVQSKRRRR---------------------
A.thaliana_AT4G39100.1#1                     -QQNLHNSNSTSNNRDAKVNGKRSLEVTKSKNKHTKRPG------------
T    M    ---2176 ---0490_46_8               -QQNLHNSNSTSNNRDAKVFLYFSFQKISLVFEGWSNPLQIGLNKFKVFK
B.napus_BN06MC06825_42494234@6               -QQDLDNSNSTSKTTDAKVNTKRSLEVSKTRNKHAKRSG------------
P.trichocarpa_scaff_IV.1226#1                GQKKLQNSHNTR-QSDAKAETKRRRR-------------------------
S.lycopersicum_TA42220_4081#1                DQKKLLNSHATSRHADIKVESKRRRR-------------------------
A.thaliana_AT4G22140.1#1                     DD-VKKSQNGFTSSPADDVKVRLSLFSHLLYRCSITYL-------------
A.thaliana_AT4G22140.2#1                     DD-VKKSQNGFTSSPADDVKVETKRRRR-----------------------
A.thaliana_AT4G04260.1#1                     EDGVKRFQNGFASSTTNDLKPSAEKMIDVRASYEL----------------
P.trichocarpa_scaff_XI.104#1                 DD-VKRSQNGFSASSLAEVENKRRKR-------------------------
P.trichocarpa_scaff_166.34#1                 DD-VKRSQNGFSVSSVTDVKVENKRRKR-----------------------
H.vulgare_TA42493_4513#1                     NG-AKRPSNSYPSSPSSDSKVEPKRRKK-----------------------
T.aestivum_c54968390@13747#1                 NG-AKRPSNSYPSSPSSDSKVEPKRRKK-----------------------
T    M    ---14367 ---4367_137               NG-AKRPSNSYPSSPSSDSKVEPKRRKW-----------------------
T.aestivum_TA54637_4565#1                    NG-AKRPSNSYPSSPSSDSKVEPKRRKR-----------------------
H.vulgare_BF623189#1                         ---------------------------------------------------
O.sativa_Os09g0386500#1                      NG-TKRPSNSYPASSNSDSKVEPKRRKR-----------------------
Z.mays_TA19459_4577999#1                     NG-AKRPSNSYSVSPNSDSKIESKRRKR-----------------------
Z.mays_ZM07MC24174_BFb0045F09@                NG-AKRPSNSYSVSPNSDSKIESKRRKR-----------------------
O.sativa_Os08g0421900#1                      NG-AKRPSHAYAGSTKYEPKAESKRQRR-----------------------
P.trichocarpa_scaff_II.2065#1                ---------------------------------------------------
S.lycopersicum_TA40478_4081#1                DD-AKRPLNSFHVEPKLVVSLFTSKGSGGLHVQSLDL--------------
P.trichocarpa_scaff_XIV.1045#1               DD-AKRSLNVFPVSPSLEVKVETKRRKR-----------------------
P.trichocarpa_scaff_1247.1#1                 ---------------------------------------------------
P.patens_149469#1                            SGEKKVRQSSPRSSPATDHVKVYILCIILMLLALPYGPSLLALFSVFC--
P.patens_108696#1                            DGDRKLRQSSPGSSPTPEHVHKPEAKRRKR---------------------
P.patens_153027#1                            TVKKSNGSSHKTPDAKVTSVEFALAAFSSIALVFHYT--------------
P.patens_59496#1                             TVKKSNGPSHMTPDAKPEPKRQRR---------------------------
P.patens_213413#1                            ---------------------------------------------------
T.aestivum_CK201479#1                        PLGSPFRALG-----------------------------------------
L.usitatissimum_LU04MC11049_62               HGFDDTDAFGSSGPYRTSTFDGGATTKRSSDEWKAF---------------
```

FIGURE 12 (continued)

O.sativa_Os07g0186400#1
T____M____---_29382_---4312_116
O.sativa_AK061201#1
Z.mays_TA12947_4577999#1
Z.mays_ZM07MC24083_BFb0146O24@
H.vulgare_TA40508_4513#1
H.vulgare_TA35269_4513#1
O.sativa_Os03g0799600#1
A.thaliana_AT4G39100.1#1
T____M____---_2176_---0490_46_8        LTVRSTYKASLANNCKLLD
B.napus_BN06MC06825_42494234@6
P.trichocarpa_scaff_IV.1226#1
S.lycopersicum_TA42220_4081#1
A.thaliana_AT4G22140.1#1
A.thaliana_AT4G22140.2#1
A.thaliana_AT4G04260.1#1
P.trichocarpa_scaff_XI.104#1
P.trichocarpa_scaff_166.34#1
H.vulgare_TA42493_4513#1
T.aestivum_c54968390@13747#1
T____M____---_14367_---4367_137
T.aestivum_TA54637_4565#1
H.vulgare_BF623189#1
O.sativa_Os09g0386500#1
Z.mays_TA19459_4577999#1
Z.mays_ZM07MC24174_BFb0045F09@
O.sativa_Os08g0421900#1
P.trichocarpa_scaff_II.2065#1
S.lycopersicum_TA40478_4081#1
P.trichocarpa_scaff_XIV.1045#1
P.trichocarpa_scaff_1247.1#1
P.patens_149469#1
P.patens_108696#1
P.patens_153027#1
P.patens_59496#1
P.patens_213413#1
T.aestivum_CK201479#1
L.usitatissimum_LU04MC11049_62

FIGURE 12 (continued)

```
                             1                                        40
  Arath_HMGA2     (1)  MDPSLSATNDPHHPPPPQFTSFPPFTNTN--PFASPNHPF
   Arath_Hon4    (1)  MDPSLG---DPHHPP--QFTPFPHFPTSN-----------
 Brana_Hon5 like  (1)  MDPSLSS--DPHRSP--QYSPFPQYPTSNSPFVSAPNLPF
 Glyma_HON5 like  (1)  ----------MEPSS---ISPPPAP---------------
  Lotja_HMGA1701  (1)  ---------------MDSIWVPPPPP--------------
   Poptr_HMGA905  (1)  -----------MDPPPPSLLIHPPLPPSS-----------
   Poptr_HMGA906  (1)  -----------MDPPPPSLLIPPPVPPSI-----------
  Vitvi_hon5 like (1)  -----------MDPAP------PPPLPP------------
  Gosar_HMGA10101 (1)  -----------MDPFFSSMPVAPPPPIP------------
  Gosar_HMGA14201 (1)  ----------------------------------------
  Orysa_HMGA2201  (1)  ----------------------------------------
  Sacof_HMGA2503  (1)  ----------------------------------------
       Consensus (1)                P          PP P 41                                       80
  Arath_HMGA2    (39)  FTGPTAVAPPNNIHLYQAAPPQQPQTSPVP------PHPS
   Arath_Hon4   (25)  --HHPLGPNPYNNHVVFQPQPQTQTQIPQPQMFQLSPHVS
 Brana_Hon5 like (37)  YGAQPVNQTPFNTHVSP-PQPQTQTLTP--------P--S
 Glyma_HON5 like (13)  --------PATAVPFPAEPNDHLPPPIPEP---------P
  Lotja_HMGA1701 (12)  --------PPTAVPFTQEAINHAPDSNIPI------NSSAP
   Poptr_HMGA905 (19)  --------PPPPTTAIPSTTETIPHLAPLP-----NPAPA
   Poptr_HMGA906 (19)  --------PPPPPTTETPTTTETPHLAPPP-----NPTPT
  Vitvi_hon5 like(12)  --------PPPPQPPAASEAHVAHAANPTP-----SHGPP
  Gosar_HMGA10101(18)  --------PPSVIPVVPPFVSNPTTATTVAG----GPPPS
  Gosar_HMGA14201 (1)  ---------------MAAVSARPPTDPVS-------AEA
  Orysa_HMGA2201  (1)  ---------------MVVAVASPSSAPGP-------GAAG
  Sacof_HMGA2503  (1)  ---------------MVVAVASPSSAAPAP-------SAG
       Consensus (41)          PP               P     P P      P  S 81                                      120
  Arath_HMGA2    (73)  ISHPPYSDMICTAIAALNEPDGSSKQAISRYIERIYTGIP
   Arath_Hon4   (63)  MPHPPYSEMICAAIAALNEPDGSSKMAISRYIERCYTGLT
 Brana_Hon5 like (66)  QTAPPYSELIVEAIAHLNEPEGSSKMAISRYIERSNPVLP
 Glyma_HON5 like (36)  SNHPPYAEMIYTAIEALKEKDGSSKRAIAKYIEQVYTQLP
  Lotja_HMGA1701 (39)  ANHPPYAEMIYRAIEALKEKDGSSKTAIAKYIEEAYTDLP
   Poptr_HMGA905 (46)  VTQPSYAEMIYSAITALKEQDGSSRIAIAKYIERAYPGLP
   Poptr_HMGA906 (46)  ITHPSYAEMIYSAITALKEQDGSSRIAIAKYIERAYPGLS
  Vitvi_hon5 like(39)  HNHPPYAEMITTAIGALNERTGSSKKAIAKYIERTFGDLP
  Gosar_HMGA10101(46)  FDHPSYSDMICEAIGALKDKNGSSKRAIAKYIESAHKDLP
  Gosar_HMGA14201(18)  LNHPSYKEMIVAAIGSLKEKNGSSEPAIAAYIASKYKDLP
  Orysa_HMGA2201 (19)  RPHPTYKEMILRALKELPDPIISSRRAIAKYISDNFSGLP
  Sacof_HMGA2503 (19)  RLHPTYKEMIMQALTELRDPGGSSRTAIANYIADHFSGLH
       Consensus (81)    HPPYAEMI  AIAALKE DGSSK AIAKYIER YTGLP
```

FIGURE 14

```
                              121                                    160
      Arath_HMGA2    (113)    TAHGALLTHHLKTLKTSGILVMVKKSYKLASTPPPPPPTS
       Arath_Hon4    (103)    SAHAALLTHHLKTLKTSGVLSMVKKSYKIAGSSTPPASVA
   Brana_Hon5_like  (106)    TDHQALLAHHLKTLKNCGVLSMVKKSYKLAASSSAPESVA
   Glyma_HON5_like   (76)    PNHSDLLTQHLNHLKSRGLLQMVKKSYALPRSVPVSVPGP
     Lotja_HMGA1701   (79)    PAHSTLLTHHLKRLKDTGLLIMLKKSYKLPSSLPSDITQN
      Poptr_HMGA905   (86)    SNHSDLLTHHLKRLKNSGALVLNKKSYMLPRSDSNANIT-
      Poptr_HMGA906   (86)    PSHSDLLTHHLKRLKNSGALVLNKKSYLLPRSDINTDISA
    Vitvi_hon5_like   (79)    PSHPALLTHHLKRLRSSGQVVMVKHSYMLPRSGDDAHALP
     Gosar_HMGA10101  (86)    PTHSALLTHHLKRLKNNGILVMVKKSYKLASTARSEVPIP
     Gosar_HMGA14201  (58)    PIHDALLSRHLSDLKKQG-IIETVHSYKLAGKAGENTGSS
      Orysa_HMGA2201  (59)    SHHDALLTVHLRRLRSQGLLLMSGHSYLLSTSATAARGRG
      Sacof_HMGA2503  (59)    SRHDALLSVHLRSLRSHGQLRLVSGNYFVSTATQQPAPGQ
         Consensus  (121)    P HSALLTHHLKRLKSSGLLVMVKKSYKLA S 161                                    200
      Arath_HMGA2    (153)    VAPSLEPPRSDFIVNE--------NQPLPDPVLASSTPQTI
       Arath_Hon4    (143)    VAAAAAQGLDVPRSE-----ILHSSNNDPMASGSASQPL
   Brana_Hon5_like  (146)    VAAAAAAGLAAPRSESPLGNPGHLDPASGAVSGSASQPQ
   Glyma_HON5_like  (116)    APTQGTSAVP---------------------AAVVAITTT
     Lotja_HMGA1701  (119)    --------------------------------AAQPVR
      Poptr_HMGA905  (125)    --TTTPTVSTSPTQIQ-----------PQYAVPVSSAPPEQ
      Poptr_HMGA906  (126)    TITTTATVSTNPPQIQ-----------PQYVAPISSAPPEQ
    Vitvi_hon5_like  (119)    LHPGPVS------------------------------GP
     Gosar_HMGA10101 (126)    DSTPSNP----------------------PDVSSPPGF
     Gosar_HMGA14201  (97)    AS--------------------------------------
      Orysa_HMGA2201  (99)    RGRPPKK----------------------ASSSAPP-Q
      Sacof_HMGA2503  (99)    KRGRGRPRK---------------IPDLAPSASIPAFQGP
         Consensus  (161)                                    S SA 201                                    240
      Arath_HMGA2    (186)    KRGRGRPPK-------AKPDVVQ----PQPLTNGKLTWEQ
       Arath_Hon4    (178)    KRGRGRPPK-------PKPESQ-----PQP--LQQLPPTN
   Brana_Hon5_like  (186)    KRGRGRPPK-------PKPEAS-----PQQQQQVVIAQPN
   Glyma_HON5_like  (135)    PRPRGRPRK-------AQNPVQNSP-LPQDTVNQVQQNA
     Lotja_HMGA1701  (125)    ---------------------------------------
      Poptr_HMGA905  (153)    KRGRGRPPK-------AKLNGLT----PTPAPVLANGQAQ
      Poptr_HMGA906  (156)    KRGRGRPPK-------TKANGLP----PTPASVLANGQPQ
    Vitvi_hon5_like  (128)    KRGRGRPPK-------PKIPVQP----TSESVLVAVGLVD
     Gosar_HMGA10101 (142)    KRSRGRPPK-------PKPTISA----PADPIPQQQQQQQ
     Gosar_HMGA14201  (99)    KK-RGRPKK------------------------------
      Orysa_HMGA2201 (114)    KRGPGRPRKNTALFPVPVLEAKPGRGRPRKNPLPVASSTS
      Sacof_HMGA2503 (124)    KRGRGRPRKNALDPVASSPSPLQGASAPPPPSGVKRGRGR
         Consensus  (201)    KRGRGRPPK        K         P      V    Q
```

FIGURE 14 (continued)

```
                              241                                        280
       Arath_HMGA2  (215) SELPVSRPEEIQIQ-----PPQ-LPLQ-PQQPV KRPPGRP
        Arath_Hon4  (204) QVQANGQPIWEQQQV---QSPVPVPTP-VTESA KRGPGRP
   Brana_Hon5_like  (214) AVQLNGQPSWEQP-----QFPVASPTQTVTESA KRGPGRP
   Glyma_HON5_like  (167) EPVWAALGLADEPVQAE--------------GS GKKRGRP
      Lotja_HMGA1701 (125) ---------------------------------- -------
       Poptr_HMGA905 (182) TGLGLNVGVTAQP------LSVGFPIDPTSSTV KKGRGRP
       Poptr_HMGA906 (185) TGLGSHVSVTAQTQSQLVVSSVGTPVDSTSTGR K-GRGRP
     Vitvi_hon5_like (157) GPVVP---------------------------- KRGPGRP
      Gosar_HMGA10101 (171) Q--------------------------------- -------
      Gosar_HMGA14201 (107) ---------------------------------- -------
       Orysa_HMGA2201 (154) SAAAAATALSLRVKRGPGRPRKNAAATPLRLGV KRGPGRP
       Sacof_HMGA2503 (164) PRKDALVPPPSSSFATG----RERLIHRLHLGS KRGRGRP
         Consensus   (241)                                    KRG GRP 281                                        320
       Arath_HMGA2  (248) RKDG-------TSPTV-----KPAASVSGGVET VKRRGRP
        Arath_Hon4  (240) RKNGS------AAPAT-----APIVQASVMAGI MKRRGRP
   Brana_Hon5_like  (249) RKDG-----------S-----APIPRPAGLSVI MKRRGRP
   Glyma_HON5_like  (193) KKSG---------ILG-----AGLTKRGRPPGS GKKPGRP
      Lotja_HMGA1701 (125) --------------------RGRPPRS---GI PKRRGRP
       Poptr_HMGA905 (216) KKVAVTEAGPLAVNKG-----KGRPPKTGPLGS KKSPGRP
       Poptr_HMGA906 (224) KKMVVTEAGPLVVKKG-----RGRPPNSGPLGS KKSPGRP
     Vitvi_hon5_like (169) PKSGG----------V-----RGPRPKS-LDGP KRRPGRP
      Gosar_HMGA10101 (172) --------------------QQPLPAPIPNDT KRSNRRP
      Gosar_HMGA14201 (107) --------------N-----LSQVTMSSPSSE KRRGRP
       Orysa_HMGA2201 (194) RKNAAATPLRLGAKRGPGRPRKNATATPLSLGV KRGPGRP
       Sacof_HMGA2503 (200) RKS------ALVPVRSSFSQLLGSIAPPLPSGV KRGRGRP
         Consensus   (281) RK G                KG      S P G  KKRRGRP 321                                        360
       Arath_HMGA2  (276) -----------PSGRAAG RER--KPIV VSAPASVF-PYV
        Arath_Hon4  (269) -----------PGRRAAG RQR--KPKS VSSTASVY-PYV
   Brana_Hon5_like  (273) -----------PGRRAAG RQR--KPLS VSSTASVF-PYV
   Glyma_HON5_like  (219) PK-----ATTTDVSASAGP KRRPGRPPK NQSQPTLI-PFA
      Lotja_HMGA1701 (141) P--------K--PKSLSNG LKR--RPPK HQLQATVI-PFA
       Poptr_HMGA905 (251) R--------K--PKSLVDA KKGPGRPPK NQLKPVTV-PYA
       Poptr_HMGA906 (259) R--------K--PKSLVGA KKGPGRPPK NQLKPVTV-PYA
     Vitvi_hon5_like (193) -----------PKAQLGG VIPGGVPRE RPRTAGVT-KVK
      Gosar_HMGA10101 (191) R--------KNGPVATLGD KKGQGRPPK TG-------PKK
      Gosar_HMGA14201 (127) -----------HKAASGP TIILPQHMK AVMKADKR-GSV
       Orysa_HMGA2201 (234) RKNAAAAASPVAPPPASPL KRGVGRPRK NATPLVKPGPGR
       Sacof_HMGA2503 (234) RKN---AYPAVAPLVGVEQ GPAGGQPQR NTTPLSPPPATV
         Consensus   (321)         P A AGG KK  GRP K   ASV  PY
```

FIGURE 14 (continued)

```
                               361                                     400
       Arath_HMGA2      (301)  ANGGVRRRGRPK----RV-------DAGGASSV APPPPPPP
        Arath_Hon4      (294)  ANG-ARRRGRPRR---VV-------DPSSIVSV APVGGE-
     Brana_Hon5_like    (298)  ANG-ARRRGRPR----RV-------DSGGVPVA APAGG--
     Glyma_HON5_like    (253)  PAVSAASVDTEHV---AASAETAPVDADAALGP RARGRPK
       Lotja_HMGA1701   (168)  DPSLAQP------------------PVPVGSP RPRGRPR
       Poptr_HMGA905    (280)  VAAPTATAIATD----AA-------AMFNVGSP RPRGRPR
       Poptr_HMGA906    (288)  VASPTAT----D----AA-------AVFNVASP KPRGRPR
     Vitvi_hon5_like    (220)  VS-----------------------------G RPRGRPP
     Gosar_HMGA10101    (216)  SP-----------------------------G RPRKP--
     Gosar_HMGA14201    (154)  ESG---------------------------GK RIRGRPK
      Orysa_HMGA2201    (274)  PSGFKRGPGRPRKNATPPVLSVPPTAAAVLGVK RGRGRPR
      Sacof_HMGA2503    (271)  PHSGKSKPVRPFRVAVDVSALRGSSMNISACSN SVVGGKE
         Consensus      (361)  AG                              V S RPRGRPR 401                                     440
       Arath_HMGA2      (330)  TN------VESGGEEVAV KKRGRGRPP -KIGGVIRKPMKPM
        Arath_Hon4      (322)  --------NVAAVAPGM K-RGRGRPP -KIGGVISRLIMKP
     Brana_Hon5_like    (324)  --------EAVAAAPGI K-RGRGRPP -KVGGVKNRLITKP
     Glyma_HON5_like    (290)  KYADEMIAAGRGRGRGR GRGGGGRGR GRGRGELPAQPRKP
       Lotja_HMGA1701   (189)  KNAAALPPPHAVGGVDS SLMVPGRPQ -KLAVRG--RPKNP
       Poptr_HMGA905    (309)  K--GAALAAAGVGAVVV QAKRPGRPP -KLPVIMKPKPKKS
       Poptr_HMGA906    (313)  K--GAAPTNAGA-VVMV QAKPPGRPA -KVPGVMKLKPKKN
     Vitvi_hon5_like    (230)  K----ILTVGAGVGGGL SVKRRGRPP -KADGPK--RPKKL
     Gosar_HMGA10101    (224)  K------TVRSVVGANA MKRGRGRPP -KVLNQMPQPAVMP
     Gosar_HMGA14201    (166)  R----FMDMAVKSSSGK PKRKPGRPM KTLALLAASAGKRK
      Orysa_HMGA2201    (314)  KDKPLQSWSVLSGGAAM TKRGPGRPR -KKRPLEAGGVVAA
      Sacof_HMGA2503    (311)  K----MQPESVQSADAS LKRGRGRPR -KEKAVESSHLKAA
         Consensus      (401)  K         AAA G GV KRGRGRPP  KL GVM     KK 441                                     480
       Arath_HMGA2      (364)  RSF---------ART GKPVGRPRK N------AVSVGA-SGR
        Arath_Hon4      (352)  K-----------RGR GRPVGRPRK ---------TGTS-VTT
     Brana_Hon5_like    (354)  K-----------RGR GRPVGRPRK NP-----WPVTVA-TGA
     Glyma_HON5_like    (330)  G---------------ARPVGRPKK G---------STSASTS
       Lotja_HMGA1701   (226)  A---------------GRP---------------
       Poptr_HMGA905    (346)  S---------------GRPVGRPRK NANAPWAITRASE-PQA
       Poptr_HMGA906    (349)  S---------------GRPVGRPRK ------------
     Vitvi_hon5_like    (263)  T---------------GRPVGRPRK KLATGEILPAASEQPVA
     Gosar_HMGA10101    (257)  IQ--------------GQPMAVPYA D-------TAAAVPTT
     Gosar_HMGA14201    (202)  R---------------- --GRPKW G-------
      Orysa_HMGA2201    (353)  QVD---------TAD GGEAGAVQN GGE----VRCLLSDGAS
      Sacof_HMGA2503    (346)  QMTEGQQEALTAQA ADQAGAVQN EVEAG----DLQSLGTS
         Consensus      (441)                  GRPVGRPRK            S  A
```

FIGURE 14 (continued)

```
                        481                                                520
Arath_HMGA2      (389)  QDGDYGELKKKFELFQARAKDIVIVLKSEIGGSGNQAVVQ
Arath_Hon4       (372)  GTQDSGELKKKFDIFQEKVKEIVKVLKDGVTS-ENQAVVQ
Brana_Hon5_like  (378)  LESAYGELKAKLDLCNEKAKEILNVLNAGIINNDNQAAVE
Glyma_HON5_like  (348)  QNAANEDLRRKLEHFQSKVKESLAVLKPHFNHESPVTAIA
Lotja_HMGA1701   (230)  ----------------------------------------
Poptr_HMGA905    (372)  QAELHGDLKRKLEFFQSRVKQAIGVLKPHLTS-ATISAVA
Poptr_HMGA906    (359)  ---VN-----VLIFTRIRV---------------------
Vitvi_hon5_like  (290)  EWMNYEDLKQKLEHIQGKIKLSVGVLRTQFSE-NNVSAMS
Gosar_HMGA10101  (277)  TAVAAGPRPXXRPKGTAVAPAGLXVPWK------------
Gosar_HMGA14201  (209)  ----SSPLSSQKKETR------------------------
Orysa_HMGA2201   (381)  SMGNRGPGSPRKEVLLENEPTVSTLVGKRGRGRPKKEKPS
Sacof_HMGA2503   (382)  FTEKRGRGRPRKRPLETETAEAGVPSSTVKRGRGRPRKEK
Consensus        (481)       GDLK  K  E    Q  K  K    L  VL                V 521                                                560
Arath_HMGA2      (429)  AIQDLEGIAETTN-EPKHMEEVQLPDEEHLETEPEAE---
Arath_Hon4       (411)  AIKDLEALTVTETVEPQVMEEVQPEETAAPQTEAQQTEAA
Brana_Hon5_like  (418)  AAQKLEGLISMMAVEPQAVEEAQPE-EAAPQTEAEEPQGE
Glyma_HON5_like  (388)  AIQELEVLGTMDLNVPLRDETLPHQVELPPPQPPVQQQQQ
Lotja_HMGA1701   (230)  ----------------------------------------
Poptr_HMGA905    (411)  AIQELEGLASMDI-NVPWREEPQPQIQPLPQPLPQMQPLP
Poptr_HMGA906    (370)  ----------------------------------------
Vitvi_hon5_like  (329)  ALQELEDLATMDISAPLNIEGQLFFGN-------------
Gosar_HMGA10101  (305)  ----------------------------------------
Gosar_HMGA14201  (221)  ----------------------------------------
Orysa_HMGA2201   (421)  AARPAETGDAKSMGIKRGRGRPRKDSSFQAVFAEAAGQVS
Sacof_HMGA2503   (422)  TLETGDPKVAQMTEGQHEALPAQAVDQGGPMQNEVEARIL
Consensus        (521)  AI  LE L                  E 561                                                600
Arath_HMGA2      (465)  ---G----QG----------Q---TEAEAMQEALF------
Arath_Hon4       (451)  ETQGGQE-EGQER---EGETQTQTEAEAMQEALF------
Brana_Hon5_like  (457)  GEGHGQEREGEEEQAPTDQTQVQTDAEAMQEALF------
Glyma_HON5_like  (428)  PPQQQLQQPPQQPPQQHLAPQQLPPQPPIFQQTYPPFHLP
Lotja_HMGA1701   (230)  ----------------------------------------
Poptr_HMGA905    (450)  QIQPLLQPQPQPQ-----PQP-QPQPQPLQQLLQS-----
Poptr_HMGA906    (370)  ----------------------------------------
Vitvi_hon5_like  (356)  ----------------------------------------
Gosar_HMGA10101  (305)  ----------------------------------------
Gosar_HMGA14201  (221)  ----------------------------------------
Orysa_HMGA2201   (461)  RDVTAAQPEGDADLLARKEPETAAVVSVENKETRPADAGG
Sacof_HMGA2503   (462)  QSFGTPLMEKRGRGRPKKRPLETETAETQGDALVKKRGRG
Consensus        (561)
```

FIGURE 14 (continued)

```
                              601                                       640
       Arath_HMGA2     (480)  ----------------------------------------
       Arath_Hon4      (481)  ----------------------------------------
      Brana_Hon5 like  (491)  ----------------------------------------
      Glyma_HON5 like  (468)  QFHHHQPSLQFQQQQQQPPQPPPQLFQHQAQPPSHQQFHP
       Lotja_HMGA1701  (230)  ----------------------------------------
       Poptr_HMGA905   (479)  ----------------------------------------
       Poptr_HMGA906   (370)  ----------------------------------------
      Vitvi_hon5 like  (356)  ----------------------------------------
       Gosar_HMGA10101 (305)  ----------------------------------------
       Gosar_HMGA14201 (221)  ----------------------------------------
       Orysa_HMGA2201  (501)  VVVSEEKTSIDPVEAGSVMPCVNAEVDRMNSDLRTANP--
       Sacof_HMGA2503  (502)  RPRKARPFETGSVETEVQVSRDLKKDRPEKDGASSVREKS
            Consensus  (601)

641
       Arath_HMGA2     (480)  --------
       Arath_Hon4      (481)  --------
      Brana_Hon5 like  (491)  --------
      Glyma_HON5 like  (508)  --------
       Lotja_HMGA1701  (230)  --------
       Poptr_HMGA905   (479)  --------
       Poptr_HMGA906   (370)  --------
      Vitvi_hon5 like  (356)  --------
       Gosar_HMGA10101 (305)  --------
       Gosar_HMGA14201 (221)  --------
       Orysa_HMGA2201  (539)  --------
       Sacof_HMGA2503  (542)  KSSRCTFG
            Consensus  (641)
```

| | | |
|---|---|---|
| P_tremuloides_575404 | (475) | VLRQI- |
| R_communis_TA2570_3988 | (494) | VLRQI- |
| A_thaliana_AT3G48730_1 | (469) | VFRQI- |
| A_thaliana_AT5G63570_1 | (468) | VLSRL- |
| B_napus_TC63445 | (470) | VLSRI- |
| B_napus_TC63450 | (469) | VLGRI- |
| N_benthamiana_TC14122 | (469) | VLGRI- |
| N_tabacum_TC18263 | (478) | VLRQL- |
| N_tabacum_TC18710 | (474) | VLKQI- |
| S_lycopersicum_TC191683 | (474) | VLKQI- |
| Aquilegia_sp_TC22821 | (478) | VFQQL- |
| C_reinhardtii_138524 | (470) | VFARI- |
| V_carteri_74470 | (459) | AFARI- |
| Chlorella_37143 | (460) | VLKSL- |
| O_lucimarinus_28523 | (455) | AMARI- |
| O_RCC809_53004 | (465) | AMARI- |
| O_taurii_24711 | (427) | AMARI- |
| C_vulgaris_43392 | (434) | VFAEI- |
| E_huxleyi_437052 | (464) | VFAEL- |
| P_tricornutum_36347 | (455) | VMAKL- |
| T_pseudonana_575 | (407) | VMAQL- |
| P_patens_116325 | (475) | VMKSL- |
| P_patens_181992 | (482) | VLKSL- |
| S_moellendorffii_183248 | (472) | VLSSI- |
| F_arundinacea_TC6452 | (469) | VLRRI- |
| H_vulgare_TC162130 | (465) | VLRWI- |
| T_aestivum_TA06MC00384_60074805_384 | (455) | NPRH-- |
| O_sativa_LOC_Os08g41990_1 | (474) | VLRRI- |
| Z_mays_ZM07MC17771_BFb0062K01_17727 | (470) | VLKRI- |
| F_vesca_TA11529_57918 | (469) | VFRQI- |
| G_max_Glyma04g00420_1 | (466) | VFREI- |
| G_max_Glyma06g00510_1 | (462) | VFREI- |
| M_truncatula_CU024868_27_4 | (464) | VFREI- |
| V_shuttleworthii_TA2337_246827 | (469) | VFRQI- |
| Consensus | (501) | VLR I |

PLANTS HAVING ENHANCED YIELD-RELATED TRAITS AND A METHOD FOR MAKING THE SAME

RELATED APPLICATIONS

This application is a national stage application (under 35 U.S.C. §371) of PCT/EP2010/052122, filed Feb. 19, 2010, which claims benefit of U.S. Provisional Application 61/155,182, filed Feb. 25, 2009 ; U.S. Provisional Application 61/155,180, filed Feb. 25, 2009; U.S. Provisional Application 61/155,192, filed Feb. 25, 2009; U.S. Provisional Application 61/155,179, filed Feb. 25, 2009; U.S. Provisional Application 61/155,177, filed Feb. 25, 2009; U.S. Provisional Application 61/155,185, filed Feb. 25, 2009; European application 09100150.3, filed Feb. 25, 2009; European application 09100148.7, filed Feb. 25, 2009; European application 09100151.1, filed Feb. 25, 2009; European application 09100147.9, filed Feb. 25, 2009; European application 09156049.0, filed Mar. 24, 2009; U.S. Provisional Application 61/162,733, filed Mar. 24, 2009; European application 09004255.7, filed Mar. 25, 2009; and U.S. Provisional Application 61/163,469, filed Mar. 26, 2009.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Revised_Sequence_List__13987__00150_US. The size of the text file is 962 KB, and the text file was created on Dec. 12, 2011.

The present invention relates generally to the field of molecular biology and concerns a method for enhancing yield related traits by modulating expression in a plant of a nucleic acid encoding a BET1-like polypeptide. The present invention also concerns plants having modulated expression of a nucleic acid encoding this BET1-like polypeptide, which plants have enhanced yield-related traits relative to corresponding wild type plants or other control plants. The invention also provides constructs useful in the methods of the invention.

The present invention relates generally to the field of molecular biology and concerns a method for improving various plant growth characteristics by modulating expression in a plant of a nucleic acid encoding a CRT (Calreticulin). The present invention also concerns plants having modulated expression of a nucleic acid encoding a Calreticulin, which plants have improved growth characteristics relative to corresponding wild type plants or other control plants. The invention also provides hereto unknown Calreticulin polynucleotides, polypeptides and constructs useful in the methods of the invention.

The present invention relates generally to the field of molecular biology and concerns a method for increasing various plant yield-related traits by increasing expression in a plant of a nucleic acid sequence encoding a tRNA dihydrouridine synthase 1-like (DUS1L) polypeptide. The present invention also concerns plants having increased expression of a nucleic acid sequence encoding a DUS1L polypeptide, which plants have increased yield-related traits relative to control plants. The invention additionally relates to nucleic acid sequences, nucleic acid constructs, vectors and plants containing said nucleic acid sequences.

The present invention relates generally to the field of molecular biology and concerns a method for enhancing yield-related traits by modulating expression in a plant of a nucleic acid encoding an ES43-like polypeptide. The present invention also concerns plants having modulated expression of a nucleic acid encoding an ES43_like polypeptide, which plants have improved growth characteristics relative to corresponding wild type plants or other control plants. The invention also provides hereto unknown ES43-like polynucleotides and polypeptides and constructs useful in the methods of the invention.

The present invention relates generally to the field of molecular biology and concerns a method for enhancing various economically important yield-related traits in plants. More specifically, the present invention concerns a method for enhancing yield-related traits in plants by modulating expression in a plant of a nucleic acid encoding an HON5-like polypeptide. The present invention also concerns plants having modulated expression of a nucleic acid encoding an HON5-like polypeptide, which plants have enhanced yield-related traits relative to control plants. The invention also provides hitherto unknown HON5-like-encoding nucleic acids, and constructs comprising the same, useful in performing the methods of the invention.

The present invention relates generally to the field of molecular biology and concerns a method for enhancing yield-related traits in plants by modulating expression in a plant of a nucleic acid encoding a glutamate-1-semialdehyde aminotransferase (GSA1) polypeptide. The present invention also concerns plants having modulated expression of a nucleic acid encoding a GSA1, which plants have enhanced yield-related traits relative to corresponding wild type plants or other control plants. The invention also provides constructs useful in the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the above-mentioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from roots, leaves and stems into the growing seed. The endosperm, in particular, assimilates the metabolic precursors of carbohydrates, oils and proteins and synthesizes them into storage macromolecules to fill out the grain.

Plant biomass is yield for forage crops like alfalfa, silage corn and hay. Many proxies for yield have been used in grain crops. Chief amongst these are estimates of plant size. Plant size can be measured in many ways depending on species and developmental stage, but include total plant dry weight, above-ground dry weight, above-ground fresh weight, leaf area, stem volume, plant height, rosette diameter, leaf length, root length, root mass, tiller number and leaf number. Many species maintain a conservative ratio between the size of different parts of the plant at a given developmental stage. These allometric relationships are used to extrapolate from one of these measures of size to another (e.g. Tittonell et al 2005 Agric Ecosys & Environ 105: 213). Plant size at an early developmental stage will typically correlate with plant size later in development. A larger plant with a greater leaf area can typically absorb more light and carbon dioxide than a smaller plant and therefore will likely gain a greater weight during the same period (Fasoula & Tollenaar 2005 Maydica 50:39). This is in addition to the potential continuation of the micro-environmental or genetic advantage that the plant had to achieve the larger size initially. There is a strong genetic component to plant size and growth rate (e.g. ter Steege et al 2005 Plant Physiology 139:1078), and so for a range of diverse genotypes plant size under one environmental condition is likely to correlate with size under another (Hittalmani et al 2003 Theoretical Applied Genetics 107:679). In this way a standard environment is used as a proxy for the diverse and dynamic environments encountered at different locations and times by crops in the field.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (*Zea mays* L.) hybrids based on Corn Belt germplasm in the European Atlantic.

Harvest index, the ratio of seed yield to aboveground dry weight, is relatively stable under many environmental conditions and so a robust correlation between plant size and grain yield can often be obtained (e.g. Rebetzke et al 2002 Crop Science 42:739). These processes are intrinsically linked because the majority of grain biomass is dependent on current or stored photosynthetic productivity by the leaves and stem of the plant (Gardener et al 1985 Physiology of Crop Plants. Iowa State University Press, pp 68-73). Therefore, selecting for plant size, even at early stages of development, has been used as an indicator for future potential yield (e.g. Tittonell et al 2005 Agric Ecosys & Environ 105: 213). When testing for the impact of genetic differences on stress tolerance, the ability to standardize soil properties, temperature, water and nutrient availability and light intensity is an intrinsic advantage of greenhouse or plant growth chamber environments compared to the field. However, artificial limitations on yield due to poor pollination due to the absence of wind or insects, or insufficient space for mature root or canopy growth, can restrict the use of these controlled environments for testing yield differences. Therefore, measurements of plant size in early development, under standardized conditions in a growth chamber or greenhouse, are standard practices to provide indication of potential genetic yield advantages.

A further important trait is that of improved abiotic stress tolerance. Abiotic stress is a primary cause of crop loss worldwide, reducing average yields for most major crop plants by more than 50% (Wang et al., Planta (2003) 218: 1-14). Abiotic stresses may be caused by drought, salinity, extremes of temperature, chemical toxicity, excess or deficiency of nutrients (macroelements and/or microelements), radiation and oxidative stress. The ability to improve plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors.

Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increasing yield (seed yield and/or biomass) in plants may be through modification of the inherent growth mechanisms of a plant, such as the cell cycle or various signalling pathways involved in plant growth or in defense mechanisms.

It has now been found that various yield-related traits may be improved in plants by modulating expression in a plant of a nucleic acid encoding a BET1-like polypeptide in a plant.

It has now also been found that various growth characteristics may be improved in plants by modulating expression in a plant of a nucleic acid encoding a Calreticulin (a CRT polypeptide) in a plant.

It has now also been found that various yield-related traits may be increased in plants relative to control plants by increasing expression in a plant of a nucleic acid sequence encoding a tRNA dihydrouridine synthase 1-like (DUS1L) polypeptide. The increased yield-related traits comprise one or more of: increased aboveground biomass, increased seed yield per plant, increased number of filled seeds, and increased total number of seeds.

It has now also been found that various growth characteristics may be improved in plants by modulating expression in a plant of a nucleic acid encoding an ES43-like polypeptide in a plant.

It has now also been found that various yield-related traits may be improved in plants by modulating expression in a plant of a nucleic acid encoding a HON5-like polypeptide in a plant.

It has now also been found that various growth characteristics may be improved in plants by modulating expression in a plant of a nucleic acid encoding a GSA1 polypeptide in a plant.

BACKGROUND

1. BET1-Like Polypeptides

Gregorio Hueros et. al. (Plant Cell, Vol. 7, 747-757, 6/1995 Am. Soc. Plant Physiol.) disclosed a cDNA clone, BET1 (for basal endosperm transfer layer), isolated from a cDNA bank prepared from 10-days after pollination (DAP) maize endosperm mRNA. BET1 mRNA showed to encode a 7-kD cell wall polypeptide. Both the mRNA and protein were restricted in their distribution to the basal endosperm transfer layer and were not expressed elsewhere in the plant. BET1 expression commenced at 9 DAP, reached a maximum between 12 and 16 DAP, and declined after 16 DAP. The initial accumulation of the BET1 polypeptide reached a plateau by 16 DAP and declined thereafter, becoming undetectable by 20 DAP. The antibody raised against the BET1 protein reacted with a number of polypeptides of higher molecular mass than the BET1 monomer. Most of these were present in cytosolic fractions and were found in nonbasal cell endosperm extracts, but three species appeared to be basal cell specific. This result and the reactivity of exhaustively extracted cell wall material with the BET1 antibody suggest that a fraction of the protein is deposited in a covalently bound form in the extracellular matrix. It was proposed that BET1 protein plays a role in the structural specialization of the transfer cells. In addition, BET1 provides a new molecular marker for the development of this endosperm domain.

2. Calreticulin Polypeptides

Calcium plays an essential role in multiple signal transduction pathways both in plants and in animals. Cytoplasmic calcium concentrations are tightly regulated at 100-200 nM but higher levels, in the range of micro- and milli-molar are found in subcellular organelles. In plants calcium is an also a micronutrient.

Calreticulin (CRT), a protein involved in the modulation of the ER (endoplasmic reticulum) Ca2+(Calcium)-ATPase, is found in all eukaryotes. Studies in mammalians filed have elucidated the structure of the CRT proteins and a number of key physiological functions, including control of cell adhesion and signal transduction through calcium-binding and quality control of protein folding and posttranscriptional modifications (Michalak. Biochem J. 2009 417(3):651-66).

Structurally CRT proteins are characterized by three distinct domains: a globular neutral N-domain, a proline-rich P-domain, and a polyacidic C-domain. CRT also has an N-terminal signal peptide sequence and an ER retention motif in the C-domain. The P-domain is responsible for the high-affinity (in the order of Kd 1.6 micromolar) and low-capacity Ca2+ binding while the C-domain is responsible for the low-affinity (in the order of Kd 0.3-2 mM) and high-capacity Ca2+ binding. CRT polypeptides include an N-terminal signal sequence and an ER-retention motif in the C-domain. Within the P-domain, there are two types of triplicate repeated motifs that are highly conserved among various animal species. However, the C-domain is less conserved than other domains of CRT. Four amino acid residues at the tip of the "extended arm" of the P-domain are critical in the chaperone function of CRT. The C-domain is involved n the Ca2+ storage in the lumen of the ER (Michalak. Biochem J. 1992, 285 (Pt 3):681-92.).

In plants, CRT proteins share same structural features and similar Ca2+ binding proteins as their animal counterparts. Phylogenetic studies revealed that plant CRT fall into two evolutionary related groups, the so called CRT1/2 and CRT3. CRT1/2 are often localized to the plasmodesmata of the cell. Plant CRT have been proposed to play a role in regeneration, gravitropism, signal transduction, and regulation of stress tolerance (Christensen et al. 2008, Plant Cell Physiol. 49(6): 912-924).

BrCRT1, a CRT form Brassica rapa when expressed in transgenic tobacco plants displayed no obvious phenotypic differences in appearance, time of flowering, or seed production when grown to maturity in soil and a weak growth inhibition of seedlings (Jin at al. 2005 Transgenic Res. 14(5):619-26).

3. tRNA Dihydrouridine Synthase 1-Like Polypeptides (DUS1L Polypeptides)

In translation, transfer RNA is the central adapter molecule as it physically links the genetic information of messenger RNA, and the addition of correctly ordered amino acids to a growing polypeptide chain. One of the structural features of tRNA is the presence of a wide variety of post-transcriptionally modified RNA bases. Dihydrouridine is one of the most abundant modified tRNA bases in prokaryotes and eukaryotes. It differs from uridine only by the reduction of uridine's carbon-carbon double bond (non-aromatic base), and is found almost exclusively at preferred positions in the D-loop of tRNA, which can further contain varying numbers of dihydrouridine residues (Bishop et al. (2002) 277(28): 25090-25095). The most likely chemical role of dihydrouridine is to enhance the conformational flexibility of tRNA, and thus improve the translational efficiencies.

The family of dihydrouridine synthase (DUS) enzymes, which catalyze the modification of uridine to dihydrouridine, has been identified in Saccharomyces cerevisiae and E. coli (Bishop et al, supra). DUSs comprise a discrete gene family (3 members in E. coli YjbN, YhdG, and Yohl, at least 4 members in yeast YML080w or DUS1, YNR015w, YLR405w, and YLR401c), allowing putative DUS genes from other organisms to be proposed based on sequence homology. Such homologs have been found for example in human, chimpanzee, dog, cow, mouse, hicken, zebrafish, fruit fly, mosquito, C. elegans, rice, and P. falciparum. In the Arabidopsis genome, at least 3 genes have been identified as potentially encoding DUS enzymes (AT3G49640, AT4G38890, AT5G67220 or DUS1 like). One of these genes encodes a polypepyide with higher similarity to the DUS1 enzyme, and is therefore called DUS1 like (DUS1L) enzyme.

In international application WO 02/66660 "Method for identifying herbicidally active substances" a nucleic acid sequence is described encoding a DUS1L polypeptide (SEQ ID NO: 84), and constructs comprising this sequence. Transgenic plants lacking the gene product present significantly delayed growth and/or completely stunted growth at the embryonic stage of Arabidopsis thaliana. The invention relates to the use of said genes and the gene products coded thereby for discovering novel herbicides.

Surprisingly, it has now been found that increasing expression in a plant of a nucleic acid sequence encoding a DUS1L polypeptide as defined herein, gives plants having increased yield-related traits relative to control plants.

According to one embodiment, there is provided a method for increasing yield-related traits in plants relative to control plants, comprising increasing expression in a plant of a nucleic acid sequence encoding a DUS1L polypeptide as defined herein. The increased yield-related traits comprise one or more of: increased aboveground biomass, increased seed yield per plant, increased number of filled seeds, and increased total number of seeds.

4. ES43-Like Polypeptides

The BAH (bromo-adjacent homology) family contains proteins such as eukaryotic DNA (cytosine-5) methyltransferases, the origin recognition complex 1 (Orc1) proteins, as well as several proteins involved in transcriptional regulation. The BAH domain appears to act as a protein-protein interaction module specialised in gene silencing, as suggested for example by its interaction within yeast Orc1p with the silent information regulator Sir1p. The BAH module might therefore play an important role by linking DNA methylation, replication and transcriptional regulation (FEBS Lett. 1999 March 5; 446(1):189-93).

PHD domains are protein Zinc finger domains that fold into an interleaved type of Zn-finger chelating 2 Zn ions in a similar manner to that of the RING and FYVE domains (Pascual et al. J Mol Biol 2000; 304:723-729). Zinc finger (Znf) domains are relatively small protein motifs that bind one or more zinc atoms, and which usually contain multiple finger-like protrusions that make tandem contacts with their target molecule. Their binding properties depend on the amino acid sequence of the finger domains and of the linker between fingers, as well as on the higher-order structures and the number of fingers. Znf domains are often found in clusters, where fingers can have different binding specificities. There are many superfamilies of Znf motifs, varying in both sequence and structure. They display considerable versatility in binding modes, even between members of the same class (e.g. some bind DNA, others protein), suggesting that Znf motifs are stable scaffolds that have evolved specialised functions. For example, Znf-containing proteins function in gene transcription, translation, mRNA trafficking, cytoskeleton organisation, epithelial development, cell adhesion, protein folding, chromatin remodelling and zinc sensing. Zinc-binding motifs are stable structures, and they rarely undergo conformational changes upon binding their target.

The PHD (homeodomain) zinc finger domain which is a C4HC3 zinc-finger-like motif found in nuclear proteins is thought to be involved in chromatin-mediated transcriptional regulation. The PHD finger motif is reminiscent of, but distinct from the C3HC4 type RING finger (Aasland et al. Trends Biochem Sci. 1995 February; 20(2):56-9).

A number of plant proteins comprising both BAH and PHD finger domains have been described. For Example the ES43 protein of Balery (Speulman and Salamini Plant Sci. 106, 91-98 (1995), SHL (Mussig et al. Mol Gen Genet. 2000 November; 264(4):363-70) and EBS (Piñeiro et al. Plant Cell. 2003 July; 15(7):1552-62) of *Arabidopsis thaliana*. EBS has been implicated in the transcriptional repressor complex that modulates chromatin structure and is required to repress the initiation of flowering in short days. Overexpression of EBS caused early flowering in *Arabidopsis thaliana* plants (Piñeiro et al. 2003).

5. HON5-Like Polypeptides

High-mobility-group (HMG) proteins are small and relatively abundant chromatin-associated proteins, biochemically defined as small proteins typically around 30 KDa, having a relatively high proportion of basic and acidic amino acids, and capable of solubilising in dilute perchloric or trichloroacetic acid.

Plants and animals possess a family of HMG proteins that are similar on the basis of a shared motif known as the AT-hook, a domain that preferentially recognizes and binds to DNA with certain structural features, such as those imparted by AT-rich DNA. Since these proteins recognize chromatin and/or DNA structure (such as the structure imparted by AT-rich DNA) rather than as specific DNA sequence, they have been named architectural transcription factors.

Much of the information available on the function of the animal HMGA family has been inferred to the plant HMG-1/Y family of AT-hook proteins.

In plants, two groups of chromosomal HMG proteins have been identified, namely the HMGA family, typically containing four A/T-hook DNA-binding motifs, and the HMGB family, containing a single HMG-box DNA-binding domain. Both plant and animal AT hook proteins bind AT-rich tracts of DNA in the minor groove, induce DNA bending, and function in the regulation of gene expression. By orchestrating multiple protein-protein and protein-DNA interactions, the HMGA proteins assist the formation of higher-order transcription factor complexes, regulating gene expression (Klosterman et al; Plant Science 162 (2002) 855_866).

SUMMARY

1. BET1-Like Polypeptides

Surprisingly, it has now been found that modulating expression of a nucleic acid encoding a BET1-like polypeptide gives plants enhanced yield-related traits, in particular increased yield relative to control plants.

According one embodiment, there is provided a method for increasing plant yield relative to control plants, comprising modulating expression of a nucleic acid encoding a BET1-like polypeptide in a plant.

2. Calreticulin Polypeptides

Surprisingly, it has now been found that modulating expression of a nucleic acid encoding a Calreticulin polypeptide gives plants having enhanced yield-related traits relative to control plants.

According one embodiment, there is provided a method for enhancing yield related traits of a plant relative to control plants, comprising modulating expression of a nucleic acid encoding a Calreticulin polypeptide in a plant.

3. ES43-Like Polypeptides

Surprisingly, it has now been found that modulating expression of a nucleic acid encoding an ES43-like polypeptide gives plants having enhanced yield-related traits in particular increased yield relative to control plants.

According one embodiment, there is provided a method for enhancing yield-related traits of a plant relative to control plants, comprising modulating expression of a nucleic acid encoding an ES43-like polypeptide in a plant.

4. HON5-Like Polypeptides

Surprisingly, it has now been found that modulating expression of a nucleic acid encoding a HON5-like polypeptide gives plants having enhanced yield-related traits, relative to control plants.

According one embodiment, there is provided a method for enhancing yield-related traits of a plant relative to control plants, comprising modulating expression of a nucleic acid encoding a HON5-like polypeptide in a plant.

5. glutamate-1-semialdehyde aminotransferase polypeptides (GSA1 polypeptides)

Surprisingly, it has now been found that modulating expression of a nucleic acid encoding a GSA1 polypeptide gives plants having enhanced yield-related traits, in particular (increased seed yield) relative to control plants.

According one embodiment, there is provided a method for enhancing yield related traits of a plant relative to control plants, comprising modulating expression of a nucleic acid encoding a GSA1 polypeptide in a plant.

Definitions

Polypeptide(s)/Protein(s)

The terms "polypeptide" and "protein" are used interchangeably herein and refer to amino acids in a polymeric form of any length, linked together by peptide bonds.

Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

Homologue(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide and may range from 1 to 10 amino acids; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions |
|---------|---------------------------|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Orthologue(s)/Paralogue(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain, Motif/Consensus Sequence/Signature

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-

D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 July 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman Miss. (1981) J. Mol. Biol. 147(1); 195-7).

Reciprocal BLAST

Typically, this involves a first BLAST involving BLASTing a query sequence (for example using any of the sequences listed in Table A of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived. The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The Tm is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The Tm may be calculated using the following equations, depending on the types of hybrids:

1) DNA-DNA hybrids (Meinkoth and Wahl, Anal. Biochem., 138: 267-284, 1984):

$$T_m = 81.5°\ C. + 16.6 \times \log_{10} [Na^+]^a + 0.41 \times \%[G/C^b] - 500 \times [L^c]^{-1} - 0.61 \times \%\ \text{formamide}$$

2) DNA-RNA or RNA-RNA hybrids:

$$T_m = 79.8 + 18.5(\log_{10} [Na^+]^a) + 0.58(\% \, G/C^b) + 11.8(\% \, G/C^b)^2 - 820/L^c$$

3) oligo-DNA or oligo-RNAs hybrids:

For <20 nucleotides: $T_m = 2(l_n)$

For 20-35 nucleotides: $T_m = 22 + 1.46(l_n)$ $^a$ or for other monovalent cation, but only accurate in the 0.01-0.4 M range.
$^b$ only accurate for % GC in the 30% to 75% range.
$^c$ L=length of duplex in base pairs.
$^d$ oligo, oligonucleotide; $l_n$, =effective length of primer=2× (no. of G/C)+(no. of A/T).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3$^{rd}$ Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (IN-DELs). The size of INDELs is usually less than 100 bp. SNPs and INDELs form the largest set of sequence variants in naturally occurring polymorphic strains of most organisms.

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene. The isolated gene may be isolated from an organism or may be manmade, for example by chemical synthesis.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Construct

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500, 0000 transcripts per cell. Conversely, a "strong promoter" drives expression of a coding sequence at high level, or at about 1/10 transcripts to about 1/100 transcripts to about 1/1000 transcripts per cell. Generally, by "medium strength promoter" is intended a promoter that drives expression of a coding sequence at a lower level than a strong promoter, in particular at a level that is in all instances below that obtained when under the control of a 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of constitutive promoters

| Gene Source | Reference |
| --- | --- |
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J Nov; 2(6): 837-44, 1992, WO 2004/065596 |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic Acids Res. 12(20): 7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table 2b below:

TABLE 2b

Examples of root-specific promoters

| Gene Source | Reference |
|---|---|
| RCc3 | Plant Mol Biol. 1995 Jan; 27(2): 237-48 |
| Arabidopsis PHT1 | Koyama et al., 2005; Mudge et al. (2002, Plant J. 31: 341) |
| Medicago phosphate transporter | Xiao et al., 2006 |
| Arabidopsis Pyk10 | Nitz et al. (2001) Plant Sci 161(2): 337-346 |
| root-expressible genes | Tingey et al., EMBO J. 6: 1, 1987. |
| tobacco auxin-inducible gene | Van der Zaal et al., Plant Mol. Biol. 16, 983, 1991. |
| β-tubulin | Oppenheimer, et al., Gene 63: 87, 1988. |
| tobacco root-specific genes | Conkling, et al., Plant Physiol. 93: 1203, 1990. |
| B. napus G1-3b gene | U.S. Pat. No. 5,401,836 |

TABLE 2b-continued

Examples of root-specific promoters

| Gene Source | Reference |
|---|---|
| SbPRP1 | Suzuki et al., Plant Mol. Biol. 21: 109-119, 1993. |
| LRX1 | Baumberger et al. 2001, Genes & Dev. 15: 1128 |
| BTG-26 Brassica napus | US 20050044585 |
| LeAMT1 (tomato) | Lauter et al. (1996, PNAS 3: 8139) |
| The LeNRT1-1 (tomato) | Lauter et al. (1996, PNAS 3: 8139) |
| class I patatin gene (potato) | Liu et al., Plant Mol. Biol. 153: 386-395, 1991. |
| KDC1 (Daucus carota) | Downey et al. (2000, J. Biol. Chem. 275: 39420) |
| TobRB7 gene | W Song (1997) PhD Thesis, North Carolina State University, Raleigh, NC USA |
| OsRAB5a (rice) | Wang et al. 2002, Plant Sci. 163: 273 |
| ALF5 (Arabidopsis) | Diener et al. (2001, Plant Cell 13: 1625) |
| NRT2;1Np (N. plumbaginifolia) | Quesada et al. (1997, Plant Mol. Biol. 34: 265) |

A seed-specific promoter is transcriptionally active predominantly in seed tissue, but not necessarily exclusively in seed tissue (in cases of leaky expression). The seed-specific promoter may be active during seed development and/or during germination. The seed specific promoter may be endosperm/aleurone/embryo specific. Examples of seed-specific promoters (endosperm/aleurone/embryo specific) are shown in Table 2c to Table 2f below. Further examples of seed-specific promoters are given in Qing Qu and Takaiwa (Plant Biotechnol. J. 2, 113-125, 2004), which disclosure is incorporated by reference herein as if fully set forth.

TABLE 2c

Examples of seed-specific promoters

| Gene source | Reference |
|---|---|
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |
| zein | Matzke et al Plant Mol Biol, 14(3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat α, β, γ-gliadins | EMBO J. 3: 1409-15, 1984 |
| barley Itr1 promoter | Diaz et al. (1995) Mol Gen Genet 248(5): 592-8 |
| barley B1, C, D, hordein | Theor Appl Gen 98: 1253-62, 1999; Plant J 4: 343-55, 1993; Mol Gen Genet 250: 750-60, 1996 |
| barley DOF | Mena et al, The Plant Journal, 116(1): 53-62, 1998 |
| blz2 | EP99106056.7 |
| synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice α-globulin REB/OHP-1 | Nakase et al. Plant Mol. Biol. 33: 513-522, 1997 |
| rice ADP-glucose pyrophosphorylase | Trans Res 6: 157-68, 1997 |
| maize ESR gene family | Plant J 12: 235-46, 1997 |
| sorghum α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | unpublished |
| PRO0147, trypsin inhibitor ITR1 (barley) | unpublished |

TABLE 2c-continued

Examples of seed-specific promoters

| Gene source | Reference |
|---|---|
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

TABLE 2d examples of endosperm-specific promoters

| Gene source | Reference |
|---|---|
| glutelin (rice) | Takaiwa et al. (1986) Mol Gen Genet 208: 15-22; Takaiwa et al. (1987) FEBS Letts. 221: 43-47 |
| zein | Matzke et al., (1990) Plant Mol Biol 14(3): 323-32 |
| wheat LMW and HMW glutenin-1 | Colot et al. (1989) Mol Gen Genet 216: 81-90, Anderson et al. (1989) NAR 17: 461-2 |
| wheat SPA | Albani et al. (1997) Plant Cell 9: 171-184 |
| wheat gliadins | Rafalski et al. (1984) EMBO 3: 1409-15 |
| barley Itr1 promoter | Diaz et al. (1995) Mol Gen Genet 248(5): 592-8 |
| barley B1, C, D, hordein | Cho et al. (1999) Theor Appl Genet 98: 1253-62; Muller et al. (1993) Plant J 4: 343-55; Sorenson et al. (1996) Mol Gen Genet 250: 750-60 |
| barley DOF | Mena et al, (1998) Plant J 116(1): 53-62 |
| blz2 | Onate et al. (1999) J Biol Chem 274(14): 9175-82 |
| synthetic promoter | Vicente-Carbajosa et al. (1998) Plant J 13: 629-640 |
| rice prolamin NRP33 | Wu et al, (1998) Plant Cell Physiol 39(8) 885-889 |
| rice globulin Glb-1 | Wu et al. (1998) Plant Cell Physiol 39(8) 885-889 |
| rice globulin REB/OHP-1 | Nakase et al. (1997) Plant Molec Biol 33: 513-522 |
| rice ADP-glucose pyrophosphorylase | Russell et al. (1997) Trans Res 6: 157-68 |
| maize ESR gene family | Opsahl-Ferstad et al. (1997) Plant J 12: 235-46 |
| *sorghum* kafirin | DeRose et al. (1996) Plant Mol Biol 32: 1029-35 |

TABLE 2e

Examples of embryo specific promoters:

| Gene source | Reference |
|---|---|
| rice OSH1 | Sato et al, Proc. Natl. Acad. Sci. USA, 93: 8117-8122, 1996 |
| KNOX | Postma-Haarsma et al, Plant Mol. Biol. 39: 257-71, 1999 |
| PRO0151 | WO 2004/070039 |
| PRO0175 | WO 2004/070039 |
| PRO005 | WO 2004/070039 |
| PRO0095 | WO 2004/070039 |

TABLE 2f

Examples of aleurone-specific promoters:

| Gene source | Reference |
|---|---|
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |

TABLE 2f-continued

Examples of aleurone-specific promoters:

| Gene source | Reference |
|---|---|
| Chi26 | Leah et al., Plant J. 4: 579-89, 1994 |
| Maize B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 2g below.

TABLE 2g

Examples of green tissue-specific promoters

| Gene | Expression | Reference |
|---|---|---|
| Maize Orthophosphate dikinase | Leaf specific | Fukayama et al., 2001 |
| Maize Phosphoenolpyruvate carboxylase | Leaf specific | Kausch et al., 2001 |
| Rice Phosphoenolpyruvate carboxylase | Leaf specific | Liu et al., 2003 |
| Rice small subunit Rubisco | Leaf specific | Nomura et al., 2000 |
| rice beta expansin EXBP9 | Shoot specific | WO 2004/070039 |
| Pigeonpea small subunit Rubisco | Leaf specific | Panguluri et al., 2005 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of green meristem-specific promoters which may be used to perform the methods of the invention are shown in Table 2h below.

TABLE 2h

Examples of meristem-specific promoters

| Gene source | Expression pattern | Reference |
|---|---|---|
| rice OSH1 | Shoot apical meristem, from embryo globular stage to seedling stage | Sato et al. (1996) Proc. Natl. Acad. Sci. USA, 93: 8117-8122 |
| Rice metallothionein | Meristem specific | BAD87835.1 |
| WAK1 & WAK 2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest.

These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with Agrobacteria, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or
(b) genetic control sequence(s) which is operably linked with the nucleic acid sequence according to the invention, for example a promoter, or
(c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. The term "modulating the activity" shall mean any change of the expression of the inventive nucleic acid sequences or encoded proteins, which leads to increased yield and/or increased growth of the plants.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell. biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Decreased Expression

Reference herein to "decreased expression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the protein of interest (target gene), or from any nucleic acid capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. mRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen. Genet. 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic [Feldman, K A and Marks M D (1987). Mol Gen Genet. 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol. Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

The genetically modified plant cells can be regenerated via all methods with which the skilled worker is familiar. Suitable methods can be found in the above-mentioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

Tilling

The term "TILLING" is an abbreviation of "Targeted Induced Local Lesions In Genomes" and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet. 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss *Physcomitrella*. Methods for performing homologous recombination in plants have been described not only for model plants (Offring a et al. (1990) EMBO J. 9(10): 3077-84) but also for crop plants, for example rice (Terada et al. (2002) Nat Biotech 20(10): 1030-4; lida and Terada (2004) Curr Opin Biotech 15(2): 132-8), and approaches exist that are generally applicable regardless of the target organism (Miller et al, Nature Biotechnol. 25, 778-785, 2007).

Yield Related Traits

Yield related traits comprise one or more of yield, biomass, seed yield, early vigour, greenness index, increased growth rate, improved agronomic traits (such as improved Water Use Efficiency (WUE), Nitrogen Use Efficiency (NUE), etc.).

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters. The term "yield" of a plant may relate to vegetative biomass (root and/or shoot biomass), to reproductive organs, and/or to propagules (such as seeds) of that plant.

Taking corn as an example, a yield increase may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per square meter, number of panicles per plant, panicle length, number of spikelets per panicle, number of flowers (florets) per panicle, increase in the seed filling rate (which is the number of filled seeds divided by the total number of seeds and multiplied by 100), increase in thousand kernel weight, among others. In rice, submergence tolerance may also result in increased yield.

Early Vigour

"Early vigour" refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increased Growth Rate

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as speed of germination, early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per square meter (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

Stress Resistance

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35%, 30% or 25%, more preferably less than 20% or 15% in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi, nematodes and insects.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location. Plants with optimal growth conditions, (grown under non-stress conditions) typically yield in increasing order of preference at least 97%, 95%, 92%, 90%, 87%, 85%, 83%, 80%, 77% or 75% of the average production of such plant in a given environment. Average production may be calculated on harvest and/or season basis. Persons skilled in the art are aware of average yield productions of a crop.

Nutrient deficiency may result from a lack of nutrients such as nitrogen, phosphates and other phosphorous-containing compounds, potassium, calcium, magnesium, manganese, iron and boron, amongst others.

The term salt stress is not restricted to common salt (NaCl), but may be any one or more of: NaCl, KCl, LiCl, $MgCl_2$, $CaCl_2$, amongst others.

Increase/Improve/Enhance

The terms "increase", "improve" or "enhance" are interchangeable and shall mean in the sense of the application at least a 3%, 4%, 5%, 6%, 7%, 8%, 9% or 10%, preferably at least 15% or 20%, more preferably 25%, 30%, 35% or 40% more yield and/or growth in comparison to control plants as defined herein.

Seed Yield

Increased seed yield may manifest itself as one or more of the following: a) an increase in seed biomass (total seed weight) which may be on an individual seed basis and/or per plant and/or per square meter; b) increased number of flowers per plant; c) increased number of (filled) seeds; d) increased seed filling rate (which is expressed as the ratio between the number of filled seeds divided by the total number of seeds); e) increased harvest index, which is expressed as a ratio of the yield of harvestable parts, such as seeds, divided by the total biomass; and f) increased thousand kernel weight (TKW), which is extrapolated from the number of filled seeds counted and their total weight. An increased TKW may result from an increased seed size and/or seed weight, and may also result from an increase in embryo and/or endosperm size.

An increase in seed yield may also be manifested as an increase in seed size and/or seed volume. Furthermore, an increase in seed yield may also manifest itself as an increase in seed area and/or seed length and/or seed width and/or seed perimeter. Increased yield may also result in modified architecture, or may occur because of modified architecture.

Greenness Index

The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Marker Assisted Breeding

Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Use as Probes in (Gene Mapping)

Use of nucleic acids encoding the protein of interest for genetically and physically mapping the genes requires only a nucleic acid sequence of at least 15 nucleotides in length. These nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the nucleic acids encoding the protein of interest. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid encoding the protein of interest in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana, Agropyron* spp., *Agrostis stolonifera, Allium* spp., *Amaranthus* spp., *Ammophila arenaria, Ananas comosus, Annona* spp., *Apium graveolens, Arachis* spp, *Artocarpus* spp., *Asparagus officinalis, Avena* spp. (e.g. *Avena sativa, Avena fatua, Avena byzantina, Avena fatua* var. *sativa, Avena hybrida*), *Averrhoa carambola, Bambusa* sp., *Benincasa hispida, Bertholletia excelsea, Beta vulgaris, Brassica* spp. (e.g. *Brassica napus, Brassica rapa* ssp. [canola, oilseed rape, turnip rape]), *Cadaba farinosa, Camellia sinensis, Canna indica, Cannabis sativa, Capsicum* spp., *Carex elata, Carica papaya, Larissa macrocarpa, Carya* spp., *Carthamus tinctorius, Castanea* spp., *Ceiba pentandra, Cichorium endivia, Cinnamomum* spp., *Citrullus lanatus, Citrus* spp., *Cocos* spp., *Coffea* spp., *Colocasia esculenta, Cola* spp., *Corchorus* sp., *Coriandrum sativum, Corylus* spp., *Crataegus* spp., *Crocus sativus, Cucurbita* spp., *Cucumis* spp., *Cynara* spp., *Daucus carota, Desmodium* spp., *Dimocarpus longan, Dioscorea* spp., *Diospyros* spp., *Echinochloa* spp., *Elaeis* (e.g. *Elaeis guineensis, Elaeis oleifera*), *Eleusine coracana, Eragrostis tef, Erianthus* sp., *Eriobotrya japonica, Eucalyptus* sp., *Eugenia uniflora, Fagopyrum* spp., *Fagus* spp., *Festuca arundinacea, Ficus carica, Fortunella* spp., *Fragaria* spp., *Ginkgo biloba, Glycine* spp. (e.g. *Glycine max, Soja hispida* or *Soja max*), *Gossypium hirsutum, Helianthus* spp. (e.g. *Helianthus annuus*), *Hemerocallis fulva, Hibiscus* spp., *Hordeum* spp. (e.g. *Hordeum vulgare*), *Ipomoea batatas, Juglans* spp., *Lactuca sativa, Lathyrus* spp., *Lens culinaris, Linum usitatissimum, Litchi chinensis, Lotus* spp., *Luffa acutangula, Lupinus* spp., *Luzula sylvatica, Lycopersicon* spp. (e.g. *Lycopersicon esculentum, Lycopersicon lycopersicum, Lycopersicon pyriforme*), *Macrotyloma* spp., *Malus* spp., *Malpighia emarginata, Mammea americana, Mangifera indica, Manihot* spp., *Manilkara zapota, Medicago sativa, Melilotus* spp., *Mentha* spp., *Miscanthus sinensis, Momordica* spp., *Morus nigra, Musa* spp., *Nicotiana* spp., *Olea* spp., *Opuntia* spp., *Ornithopus* spp., *Oryza* spp. (e.g. *Oryza sativa, Oryza latifolia*), *Panicum miliaceum, Panicum virgatum, Passiflora edulis, Pastinaca sativa, Pennisetum* sp., *Persea* spp., *Petroselinum crispum, Phalaris arundinacea, Phaseolus* spp., *Phleum pratense, Phoenix* spp., *Phragmites australis, Physalis* spp., *Pinus* spp., *Pistacia vera, Pisum* spp., *Poa* spp., *Populus* spp., *Prosopis* spp., *Prunus* spp., *Psidium* spp., *Punica granatum, Pyrus communis, Quercus* spp., *Raphanus sativus, Rheum rhabarbarum, Ribes* spp., *Ricinus communis, Rubus* spp., *Saccharum* spp., *Salix* sp., *Sambucus* spp., *Secale cereale, Sesamum* spp., *Sinapis* sp., *Solanum* spp. (e.g. *Solanum tuberosum, Solanum integrifolium* or *Solanum lycopersicum*), *Sorghum bicolor, Spinacia* spp., *Syzygium* spp., *Tagetes* spp., *Tamarindus indica, Theobroma cacao, Trifolium* spp., *Tripsacum dactyloides, Triticosecale rimpaui, Triticum* spp. (e.g. *Triticum aestivum, Triticum durum, Triticum turgidum, Triticum hybernum, Triticum macha, Triticum sativum, Triticum monococcum* or *Triticum vulgare*), *Tropaeolum minus, Tropaeolum majus, Vaccinium* spp., *Vida* spp., *Vigna* spp., *Viola odorata, Vitis* spp., *Zea mays, Zizania palustris, Ziziphus* spp., amongst others.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

DETAILED DESCRIPTION OF THE INVENTION

Surprisingly, it has now been found that modulating expression in a plant of a nucleic acid encoding a BET1-like polypeptide gives plants having enhanced yield-related traits relative to control plants. According to a first embodiment, the present invention provides a method for enhancing yield-related traits in plants relative to control plants, comprising modulating expression in a plant of a nucleic acid encoding a BET1-like polypeptide and optionally selecting for plants having enhanced yield-related traits.

The invention also provides hitherto unknown BET1-like-encoding nucleic acids and BET1-like polypeptides.

According to a further embodiment of the present invention, there is therefore provided an isolated nucleic acid molecule selected from:

(i) a nucleic acid represented by any one of SEQ ID NO: 11 and 95;
(ii) the complement of a nucleic acid represented by any one of SEQ ID NO: 11 and 95;
(iii) a nucleic acid encoding the polypeptide as represented by any one of SEQ ID NO: 12 and 96 preferably as a result of the degeneracy of the genetic code, said isolated nucleic acid can be derived from a polypeptide sequence as represented by any one of SEQ ID NO: 12 and 96 and further preferably confers enhanced yield-related traits relative to control plants;
(iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A1 and further preferably conferring enhanced yield-related traits relative to control plants;
(v) a nucleic acid molecule which hybridizes with a nucleic acid molecule of (i) to (iv) under stringent hybridization conditions and preferably confers enhanced yield-related traits relative to control plants;
(vi) a nucleic acid encoding a BET1-like polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 12 and 96 and to any of the other amino acid sequences in Table A1 and preferably conferring enhanced yield-related traits relative to control plants.

According to a further embodiment of the present invention, there is also provided an isolated polypeptide selected from:

(i) an amino acid sequence represented by any one of SEQ ID NO: 12 and 96;
(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 12 and 96 and any of the other amino acid sequences in Table A1 and preferably conferring enhanced yield-related traits relative to control plants.
(iii) derivatives of any of the amino acid sequences given in (i) or (ii) above.

Furthermore, it has now surprisingly been found that modulating expression in a plant of a nucleic acid encoding a Calreticulin polypeptide gives plants having enhanced yield-related traits relative to control plants. According to a first embodiment, the present invention provides a method for enhancing yield-related traits in plants relative to control plants, comprising modulating expression in a plant of a nucleic acid encoding a Calreticulin polypeptide and optionally selecting for plants having enhanced yield-related traits.

The invention also provides hitherto unknown Calreticulin-encoding nucleic acids and Calreticulin polypeptides.

According to a further embodiment of the present invention, there is therefore provided an isolated nucleic acid molecule selected from:
(i) a nucleic acid represented by any one of SEQ ID NO: 116, 130, 140, 198 and 228;
(ii) the complement of a nucleic acid represented by any one of SEQ ID NO: 116, 130, 140, 198 and 228;
(iii) a nucleic acid encoding the polypeptide as represented by any one of SEQ ID NO: 117, 131, 141, 199 and 229 preferably as a result of the degeneracy of the genetic code, said isolated nucleic acid can be derived from a polypeptide sequence as represented by any one of SEQ ID NO: 117, 131, 141, 199 and 229 and further preferably confers enhanced yield-related traits relative to control plants;
(iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A2 and further preferably conferring enhanced yield-related traits relative to control plants;
(v) a nucleic acid molecule which hybridizes with a nucleic acid molecule of (i) to (iv) under stringent hybridization conditions and preferably confers enhanced yield-related traits relative to control plants;
(vi) a nucleic acid encoding a Calreticulin polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 117, 131, 141, 199 and 229 and any of the other amino acid sequences in Table A2 and preferably conferring enhanced yield-related traits relative to control plants.

According to a further embodiment of the present invention, there is also provided an isolated polypeptide selected from:
(i) an amino acid sequence represented by any one of SEQ ID NO: 117, 131, 141, 199 and 229;
(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 117, 131, 141, 199 and 229 and any of the other amino acid sequences in Table A2 and preferably conferring enhanced yield-related traits relative to control plants.
(iii) derivatives of any of the amino acid sequences given in (i) or (ii) above.

Furthermore, it has now surprisingly been found that increasing expression in a plant of a nucleic acid sequence encoding a DUS1L polypeptide as defined herein, gives plants having increased yield-related traits relative to control plants. According to a first embodiment, the present invention provides a method for increasing yield-related traits in plants relative to control plants, comprising increasing expression in a plant of a nucleic acid sequence encoding a DUS1L polypeptide.

The invention also provides hitherto unknown nucleic acid sequences encoding DUS1L polypeptides, and DUS1L polypeptides.

According to one embodiment of the present invention, there is therefore provided an isolated nucleic acid molecule selected from:
(i) a nucleic acid sequence as represented by SEQ ID NO: 264 or by SEQ ID NO: 292;
(ii) the complement of a nucleic acid sequence as represented by SEQ ID NO: 264 or by SEQ ID NO: 292;
(iii) a nucleic acid sequence encoding a DUS1L polypeptide having, in increasing order of preference, at least 30%, 35%, 40%, 45%, 50%, 55%, 60%, 65%, 70%, 75%, 80%, 85%, 90%, 95%, 96%, 97%, 98%, 99% or more amino acid sequence identity to the polypeptide sequence represented by SEQ ID NO: 265 or by SEQ ID NO: 293.

According to a further embodiment of the present invention, there is also provided an isolated polypeptide selected from:
(i) a polypeptide sequence as represented by SEQ ID NO: 265 or by SEQ ID NO: 293;
(ii) a polypeptide sequence having, in increasing order of preference, at least 30%, 35%, 40%, 45%, 50%, 55%, 60%, 65%, 70%, 75%, 80%, 85%, 90%, 95%, 96%, 97%, 98%, 99% or more amino acid sequence identity to a polypeptide sequence as represented by SEQ ID NO: 265 or by SEQ ID NO: 293;
(iii) derivatives of any of the polypeptide sequences given in (i) or (ii) above.

Furthermore, it has now surprisingly been found that modulating expression in a plant of a nucleic acid encoding an ES43-like polypeptide gives plants having enhanced yield-related traits relative to control plants. According to a first embodiment, the present invention provides a method for enhancing yield-related traits in plants relative to control plants, comprising modulating expression in a plant of a nucleic acid encoding an ES43-like polypeptide and optionally selecting for plants having enhanced yield-related traits.

The invention also provides hitherto unknown ES43-like-encoding nucleic acids and ES43-like polypeptides.

According to a further embodiment of the present invention, there is therefore provided an isolated nucleic acid molecule selected from:
(i) a nucleic acid represented by any one of SEQ ID NO: 308, 370, and 372;
(ii) the complement of a nucleic acid represented by any one of SEQ ID NO: 308, 370, and 372;
(iii) a nucleic acid encoding the polypeptide as represented by any one of SEQ ID NO: 309, 371 and 373 preferably as a result of the degeneracy of the genetic code, said isolated nucleic acid can be derived from a polypeptide sequence as represented by any one of SEQ ID NO: 309, 371 and 373 and further preferably confers enhanced yield-related traits relative to control plants;
(iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A4 and further preferably conferring enhanced yield-related traits relative to control plants;
(v) a nucleic acid molecule which hybridizes with a nucleic acid molecule of (i) to (iv) under stringent hybridization conditions and preferably confers enhanced yield-related traits relative to control plants;
(vi) a nucleic acid encoding a ES43-like polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 309, 371 and 373 and any of the other amino acid sequences in Table A4 and preferably conferring enhanced yield-related traits relative to control plants.

According to a further embodiment of the present invention, there is also provided an isolated polypeptide selected from:
(i) an amino acid sequence represented by any one of SEQ ID NO: 309, 371 and 373;
(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 309, 371 and 373 and any of the other amino acid sequences in Table A4 and preferably conferring enhanced yield-related traits relative to control plants.
(iii) derivatives of any of the amino acid sequences given in (i) or (ii) above.

Furthermore, it has now surprisingly been found that modulating expression in a plant of a nucleic acid encoding a HON5-like polypeptide gives plants having enhanced yield-related traits relative to control plants. According to a first embodiment, the present invention provides a method for enhancing yield-related traits in plants relative to control plants, comprising modulating expression in a plant of a nucleic acid encoding a HON5-like polypeptide and optionally selecting for plants having enhanced yield-related traits.

The invention also provides hitherto unknown HON5-like-encoding nucleic acids and HON5-like polypeptides.

According to a further embodiment of the present invention, there is therefore provided an isolated nucleic acid molecule selected from:
(i) a nucleic acid represented by any one of SEQ ID NO: 393 and 395;
(ii) the complement of a nucleic acid represented by any one of SEQ ID NO: 393 and 395;
(iii) a nucleic acid encoding the polypeptide as represented by any one of SEQ ID NO: 393 and 395 preferably as a result of the degeneracy of the genetic code, said isolated nucleic acid can be derived from a polypeptide sequence as represented by any one of SEQ ID NO: 394 and 396 and further preferably confers enhanced yield-related traits relative to control plants;
(iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A5 and further preferably conferring enhanced yield-related traits relative to control plants;
(v) a nucleic acid molecule which hybridizes with a nucleic acid molecule of (i) to (iv) under stringent hybridization conditions and preferably confers enhanced yield-related traits relative to control plants;
(vi) a nucleic acid encoding a HON5-like polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 394 and 396 and any of the other amino acid sequences in Table A5 and preferably conferring enhanced yield-related traits relative to control plants.

According to a further embodiment of the present invention, there is also provided an isolated polypeptide selected from:
(i) an amino acid sequence represented by any one of SEQ ID NO: 394 and 396;
(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 394 and 396 and any of the other amino acid sequences in Table A5 and preferably conferring enhanced yield-related traits relative to control plants.
(iii) derivatives of any of the amino acid sequences given in (i) or (ii) above.

Furthermore, it has now surprisingly been found that modulating expression in a plant of a nucleic acid encoding a GSA1 polypeptide gives plants having enhanced yield-related traits relative to control plants. According to a first embodiment, the present invention provides a method for enhancing yield-related traits in plants relative to control plants, comprising modulating expression in a plant of a nucleic acid encoding a GSA1 polypeptide and optionally selecting for plants having enhanced yield-related traits.

A preferred method for modulating (preferably, increasing) expression of a nucleic acid encoding a BET1-like polypeptide, or a Calreticulin polypeptide, or a DUS1L polypeptide, or an ES43-like polypeptide, or a HON5-like polypeptide, or a GSA1 polypeptide, is by introducing and expressing in a plant a nucleic acid encoding a BET1-like polypeptide, or a Calreticulin polypeptide, or a DUS1L polypeptide, or an ES43-like polypeptide, or a HON5-like polypeptide, or a GSA1 polypeptide.

Concerning BET1-like polypeptides, any reference hereinafter to a "protein useful in the methods of the invention" is taken to mean a BET1-like polypeptide as defined herein. Any reference hereinafter to a "nucleic acid useful in the methods of the invention" is taken to mean a nucleic acid capable of encoding such a BET1-like polypeptide. The nucleic acid to be introduced into a plant (and therefore useful in performing the methods of the invention) is any nucleic acid encoding the type of protein which will now be described, hereafter also named "BET1-like nucleic acid" or "BET1-like gene".

Concerning Calreticulin polypeptides, any reference hereinafter to a "protein useful in the methods of the invention" is taken to mean a Calreticulin polypeptide as defined herein. Any reference hereinafter to a "nucleic acid useful in the methods of the invention" is taken to mean a nucleic acid capable of encoding such a Calreticulin polypeptide. The nucleic acid to be introduced into a plant (and therefore useful in performing the methods of the invention) is any nucleic acid encoding the type of protein which will now be described, hereafter also named "Calreticulin nucleic acid" or "Calreticulin gene".

Concerning DUS1L polypeptides, any reference hereinafter to a "protein useful in the methods of the invention" is taken to mean a DUS1L polypeptide as defined herein. Any reference hereinafter to a "nucleic acid sequence useful in the methods of the invention" is taken to mean a nucleic acid sequence capable of encoding such a DUS1L polypeptide. The nucleic acid sequence to be introduced into a plant (and therefore useful in performing the methods of the invention) is any nucleic acid sequence encoding the type of polypeptide, which will now be described, hereafter also named "DUS1L nucleic acid sequence" or "DUS1L gene".

Concerning ES43-like polypeptide, any reference hereinafter to a "protein useful in the methods of the invention" is taken to mean an ES43-like polypeptide as defined herein. Any reference hereinafter to a "nucleic acid useful in the methods of the invention" is taken to mean a nucleic acid capable of encoding such an ES43-like polypeptide. The nucleic acid to be introduced into a plant (and therefore useful in performing the methods of the invention) is any nucleic acid encoding the type of protein which will now be described, hereafter also named "ES43-like nucleic acid" or "ES43-like gene".

Concerning HON5-like polypeptides, any reference hereinafter to a "protein useful in the methods of the invention" is taken to mean a HON5-like polypeptide as defined herein. Any reference hereinafter to a "nucleic acid useful in the methods of the invention" is taken to mean a nucleic acid capable of encoding such a HON5-like polypeptide. The nucleic acid to be introduced into a plant (and therefore useful in performing the methods of the invention) is any nucleic acid encoding the type of protein which will now be described, hereafter also named "HON5-like nucleic acid" or "HON5-like gene".

Concerning GSA1 polypeptides, any reference hereinafter to a "protein useful in the methods of the invention" is taken to mean a GSA1 polypeptide as defined herein. Any reference hereinafter to a "nucleic acid useful in the methods of the invention" is taken to mean a nucleic acid capable of encoding such a GSA1 polypeptide. The nucleic acid to be introduced into a plant (and therefore useful in performing the methods of the invention) is any nucleic acid encoding the type of protein which will now be described, hereafter also named "GSA1 nucleic acid" or "GSA1 gene".

A "BET1-like polypeptide" as defined herein refers to any polypeptide comprising a CC domain as defined by SEQ ID No 97: $C(X_1)a\ C(X_2)c\ (Y)c\ G(X_3)d\ C(X_4)\ C$, wherein:

$X_1, X_2, X_3$ and $X_4$ may be any amino acid,
Y may be any amino acid or none (no amino acid),
 a means up to 3 times $X_1$,
 b means up to 7 times $X_2$,
 c means up to 2 times Y,
 d means up to 15 times $X_3$ In a further embodiment of the present invention, d is preferably 8, 10 or 11 times of the amino acids represented by $X_3$.

A preferred CC domain according the present invention is a domain having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the domain represented by SEQ ID NO 98: CRLICSSKGFKDGG WCDESVEHKVCCC Additionally, another preferred embodiment of the present invention refers to a BET1-like polypeptide comprising the CC domain, as defined above, and the following motifs Motif 1 and/or Motif 2:

```
Motif 1: G(W/Y)CD(E/K);    (SEQ ID NO: 99)

Motif 2: EGF               (SEQ ID NO: 100)
```

The most preferable embodiment of the present invention refers to a BET1-like polypeptide comprising the CC domain, as defined above, and the motif 1 (which is present in SEQ ID NO: 2), also as defined above.

In another preferably embodiment of the present invention, the BET1-like polypeptide comprises a sequence such as SEQ ID NO: 2:

```
SEQ ID NO: 2:
MAVMKSSTMVALLLAVAILSSLSPCYEAGGCIGKPKKSPPPPRKPYFSS

YSEDHQNCRLICSSKGFKDGGWCDESVEHKVCCCSH.
```

Alternatively, the homologue of a BET1-like polypeptide has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by any of the polypeptides of Table A1, preferably by SEQ ID NO: 2, provided that the homologous protein comprises the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

Calreticulin polypeptides are well known in the art. (Christianssen et al 2008. Plant Cell Physiol. 2008 June; 49(6):912-24). A Calreticulin polypeptide typically refers to any polypeptide comprising three distinct structural and functional domains with loosely defined boundaries: the nearly neutral N-domain, the proline-rich P-domain, and the polyacidic C-domain (FIG. 4).

A preferred Calreticulin polypeptide useful in the methods of the invention is a polypeptide comprising one or more of the following motifs:

(i) Motif 3: PXXIXDPXXKKPEXWDD (SEQ ID NO: 246),
(ii) Motif 4: GXWXXXXIXNPXYK (SEQ ID NO: 247),
(iii) Motif 5: E[VL]WQVK (SEQ ID NO: 248),
(iv) Motif 6: TLV[FL]QFSVKHEQKLDCGGGY[MV]KLLSGDVDQKKFGG[DE]PYSI MFGPDICGY (SEQ ID NO: 249) which represents typical CRT plant polypeptides of the CRT1/2 group;
(v) Motif 7: TPYS[LF]MFGPD[IL]CGTQTKKLH[VL]ILSYQGQNYPIKKDL[QE]CETD KLTH[FV]YTFI (SEQ ID NO: 250) which represents typical CRT plant polypeptides of the CRT3 group;
(vi) Motif 8: N[HY][LP]IKK[DE][VL]PCETD[QK]LTH[VF]YTFI[LI]RPDA[TS]YSILIDN[VR]E[KR][QE][TS]GS[LM]Y[TS]DWD[IL]L (SEQ ID NO: 251) which represents typical CRT polypeptides of the viridiplantae kingdom;
(vii) Motif 9: QKKFGGDTPYSIMFGPDICGY[SQ]TKK[VL]H[AV]I] (SEQ ID NO: 252), which represents typical CRT polypeptides of the eukaryotic origin,
(viii) a motif having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to any one of the motifs (i) to (vii);

Wherein "X" represents any amino acid and wherein amino acids indicated between brackets "[ ]" represent alternative amino acids at that location.

Preferred Calreticulin polypeptides of the invention comprise a signal peptide in N term and a ER retention signal ((H/K)DEL) in C term, preferably any of those disclosed in Christianssen et al 2008.

A preferred polypeptide of the invention refers in increasing order of preference to any polypeptide of Table A2, an orthologue or a homologue of any of the Calreticulin polypeptides given in Table A2.

Alternatively, the homologue of a Calreticulin protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 105, provided that the homologous protein comprises the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

Preferably, the polypeptide sequence which when used in the construction of a phylogenetic tree, such as the one depicted in Christensen et al. 2008-FIG. 1 and herein reproduced in FIG. 5, clusters with the group of At_CRT1a or At_CRT1b, Os_CRT1a or Os_CRT1b, and Os_CRT3 or At_CRT3 polypeptides, preferably with the group of At_CRT1a or At_CRT1b, Os_CRT1a or Os_CRT1b. Alternatively, the polypeptide sequence which when used in the construction of a phylogenetic tree, such as the one described in Example 2 cluster with any one of the polypeptide within in the following phylogenetic classes: class 1-CRT1,2-CRT3,3-algae, 4-animal and 5-protist of Example 2, preferably with class 1-CRT1.

A "DUS1L polypeptide" as defined herein refers to any polypeptide comprising (i) a tRNA-dihydrouridine synthase domain with an InterPro entry IPR001269; (ii) an aldolase-type TIM barrel domain with an InterPro entry IPR013785; and (iii) a tRNA-dihydrouridine synthase conserved site with an InterPro entry IPR018517.

Alternatively or additionally, "DUS1L polypeptide" as defined herein refers to any polypeptide comprising in increasing order of preference at least 50%, 55%, 60%, 65%, 70%, 75%, 80%, 85%, 90%, 95%, 98%, 99% or more amino acid sequence identity to a tRNA-dihydrouridine synthase domain as represented by SEQ ID NO: 294.

Alternatively or additionally, a "DUS1L polypeptide" as defined herein refers to any polypeptide sequence comprising in increasing order of preference at least 30%, 35%, 40%, 45%, 50%, 55%, 60%, 65%, 70%, 75%, 80%, 85%, 90%, 95%, 98%, 99% or more amino acid sequence identity to a polypeptide as represented by SEQ ID NO: 259.

Alternatively or additionally, a "DUS1L polypeptide" as defined herein refers to any polypeptide comprising in increasing order of preference at least 30%, 35%, 40%, 45%, 50%, 55%, 60%, 65%, 70%, 75%, 80%, 85%, 90%, 95%, 98%, 99% or more amino acid sequence identity to any of the polypeptide sequences given in Table A3 herein.

Additionally, a "DUS1L polypeptide" as defined herein can functionally complement an *E. coli* strain deficient in tRNA dihydrouridine synthase activity, thereby increasing tRNA dihydrouridine content.

An "ES43-like polypeptide" as defined herein refers to any polypeptide comprising a comprising a BAH domain (Pfam accession number: PF01426) and a PHD domain (Pfam accession number: PF00628).

A BAH domain is well known in the art (Callebaut et al. FEBS letts 1999; 446:189-193). A PHD domain is well known in the art (Aasland R, et al. Trends Biochem Sci 1995; 20:56-59). Methods to identify a BAH domain and a PHD domain are well known in the art, for example identification by consulting Structural domain databases and/or Sequence domain databases.

Examples of Structural Databases:
CATH (Orengo et al. (1997). Structure, 5, 1093-1108; Alison et al. Nucleic Acids Research, 2009, Vol. 37).
DALI (Holm, 2008. Bioinformatics 24, 2780-2781)°
SCOP (Murzin et al. *J. Mol. Biol.* 247, 536-540; Andreeva et al. Nucl. Acid Res. 36: D419-D425)

Examples of Sequence Domain Databases:
InterPro (Hunters et al. 2009 Nucleic Acids Res. 37 (Database Issue):D224-228; Quevillon et al. 2005 Nucleic Acids Res. 33 (Web Server issue):W116-W120).
Pfam (Finn Nucleic Acids Research (2008) Database Issue 36:D281-D288).

SMART (Schultz et al. (1998) PNAS 95: 5857-5864; Letunic et al. 2004, NAR 32, D142-D144).

NCBI Conserved Domain Database (Marchler-Bauer et al. Nucleic Acids Res. 2007; 35 (Database Issue):D237-40).

SUPERFAMILY Library of HMMs representing superfamilies and database of (superfamily and family) annotations for all completely sequenced organisms (Gough et al. J. Mol. Biol., 313(4), 903-919).

Further details on method to consult specific protein domain databases are provided in the Examples section.

A preferred ES43-like polypeptide according to the invention is a polypeptide comprising a domain having an amino acid sequence in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence of SEQ ID NO: 374 (BAH domain of SEQ ID NO: 299) or to the amino acid sequence of SEQ ID NO: 375 (PHD domain of SEQ ID NO: 299.

Further preferably the ES43-like polypeptide according to the invention comprises any one or more of the following protein motifs:

| | | | |
|---|---|---|---|
| (i) | Motif 10: | VRVRVRWYY; | (SEQ ID NO: 376) |
| (ii) | Motif 11: | RPEE; | (SEQ ID NO: 377) |
| (iii) | Motif 12: | TIEGKC; | (SEQ ID NO: 378) |
| (iv) | Motif 13: | GDCVLMR; | (SEQ ID NO: 379) |
| (v) | Motif 14: | YVAR; | (SEQ ID NO: 380) |
| (vi) | Motif 15: | GAKE; | (SEQ ID NO: 381) |
| (vii) | Motif 16: | CRFEY; | (SEQ ID NO: 382) |
| (viii) | Motif 17: | HEAT | (SEQ ID NO: 383) |

A yet further preferable ES43-like polypeptide is a homologue, preferably a paralogue or an orthologue of the ES43-like polypeptide represented by SEQ ID NO: 299.

Preferably the BAH domain is located the N-terminus of the ES43-like polypeptide while the PHD domain is located at the C-terminus.

Alternatively, the homologue of an ES43-like protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 299, provided that the homologous protein comprises the conserved domains as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. For local alignments, the Smith-Waterman algorithm is particularly useful (Smith T F, Waterman Miss. (1981) J. Mol. Biol. 147(1); 195-7).

A "HON5-like polypeptide" as defined herein refers to any polypeptide comprising a histone H1/H5 domain (Pfam: PF00538; Interpro: IPR005818) and at least two, preferably two, three, four, five, six or seven AT-hook domains (Pfam: PF02178; InterPro: IPR000637).

Histone H1/H5 protein domains (Pfam: PF00538; Interpro: IPR005818) are well known in the art. Histone H1/H5 protein domain may be represented by the consensus sequence: HPPYAEMIAIAALKEDGSSKAIAKYI-ERYTGLPPHSALLTHHLKRLKSSGLLVMVKKSYKLA S (SEQ ID NO: 411). The consensus sequence shows which residues are most conserved (abundant) at each position in the histone H1/H5 domain in H1 or H5 proteins of different origin. The skilled in the art will recognize that histone H1/H5 domain in specific H1 polypeptide may differ from that specified in the consensus, while the overall homology along the domain remains.

A preferred histone H1/H5 domain present in HON5-like polypeptides refers to a domain having in increasing order of preference at least 50%, 55%, 60%, 65%, 70%, 75%, 80%, 85%, 90%, 95%, 96%, 97%, 98%, 99% or more sequence identity to the consensus sequence of the H1/H5 protein domain as represented by SEQ ID NO: 410. A further preferred H1/H5 histone domain is any one of the H1/H5 histone domains as present in the polypeptides of Table A5, most preferably in SEQ ID NO: 388.

AT hook domains also known as AT hook motifs are well known in the art. AT hooks are DNA-binding motifs with a preference for A/T rich regions. These motifs are found in a variety of proteins, including the high mobility group (HMG) proteins (Reeves and Beckerbauer .Biochim. Biophys. Acta 1519 13-29 2001. The ATHook domain is registered in Interporo database with reference accession number: InterPro: IPR017956 under the name AT hook, DNA-binding, conserved site (Hunter et al; 2009, Nucleic Acids Res. 37 Database Issue: D224-228), and in the pfam database (Finn et al. Nucleic Acids Research (2008) Database Issue 36:D281-D288) under the reference accession number PF02178 with the name "AT hook motif". A preferred AT hook domain present in HON5-like polypeptides refers to a domain having in increasing order of preference at least 50%, 55%, 60%, 65%, 70%, 75%, 80%, 85%, 90%, 95%, 96%, 97%, 98%, 99% or more sequence identity to any of the AT hook motifs present in the polypeptides of Table A5, more preferably in SEQ ID NO: 388.

Additionally or alternatively and preferably, a HON5-like polypeptide comprises one or more motifs having in increasing order of preference at least 50%, 55%, 60%, 65%, 70%, 75%, 80%, 85%, 90%, 95%, 96%, 97%, 98%, 99% or more sequence identity to any one of the following Motifs:

```
Motif I:
                                                         (SEQ ID NO: 411)
Y[ASK]EMI[YC]TAI[AGT]AL[KN][ED][PK]DGSS[KR]RAI[AS][KR]YIERA[YF][TP][GD]

LP[PS]AH[SD][AD]LLTHHLK[RT]L[KR]

Motif II:
                                                         (SEQ ID NO: 412)
GLLV[ML]VK[KH]SYKL[AP][RS]S Motif III:
                                                         (SEQ ID NO: 413)
SA[PS][PQS]GQKRGRGRPPKPK
``` wherein amino acids between brackets represent alternative amino acids at that position.

Motif I and Motif II are typically located within the H1/H5 domain, while Motif III typically overlaps with AT-hook domains.

Alternatively, the homologue of a HON5-like protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by any of the polypeptides in Table A5 preferably by SEQ ID NO: 388 and preferably comprises Motif I, II and III as defined above.

The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. For local alignments, the Smith-Waterman algorithm is particularly useful (Smith T F, Waterman Miss. (1981) J. Mol. Biol. 147(1); 195-7).

A "GSA1 polypeptide" as defined herein refers to any polypeptide comprising any one or more of:

Alternatively, the homologue of a GSA1 protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 418, provided that the homologous protein comprises the conserved motifs as outlined above.

The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. For local alignments, the Smith-Waterman algorithm is particularly useful (Smith T F, Waterman Miss. (1981) J. Mol. Biol. 147(1); 195-7).

Preferably, the polypeptide sequence which when used in the construction of a phylogenetic tree, such as the one depicted in FIG. 17, clusters with the group of GSA1 polypeptides comprising the amino acid sequence represented by SEQ ID NO: 418 rather than with any other group.

The terms "domain", "signature" and "motif" are defined in the "definitions" section herein. Specialist databases exist for the identification of domains, for example, SMART Domain 1:

(SEQ ID NO: 487)

VPS[IV]EMVRFVNSGTEAC[ML][GS][VA]LRL[AM]RA[FY]TGREK[IV][IL]K

FEGCYHGHAD[PS]FLVK

Domain 2:

(SEQ ID NO: 488)

NSPVRAFKSVGGQP[IV]V[FI]D[SR]VKG[SA][HRY][MA]WD[IV]DGN[EK]

Y[IV]DYVGSWGPAIIGHADD

Domain 3:

(SEQ ID NO: 489)

AQEYFGITPD[LV]TT[LM]GK[IV]IGGGLPVGAYGG[RK][RK][ED]IMEMVAP

AGPMYQAGTLS or a domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to any one or more of domains 1 to 3.

(Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Concerning DUS1L polypeptides, an alignment of the polypeptides of Table A3 herein, is shown in FIG. 9. Such alignments are useful for identifying the most conserved domains or motifs between the DUS1L polypeptides as defined herein. One such domain is a tRNA-dihydrouridine synthase domain with an InterPro entry IPR001269 (integrating the PFAM PF01207 entry (marked by X's in FIG. 9)). One such motif is the tRNA-dihydrouridine synthase conserved site with an InterPro entry IPR018517 (integrating the PROSITE PS01136 (marked by X's in FIG. 9). Conserved residues are boxed in FIG. 9, in particular a Cys residue which is in other organisms a key general-acid/base catalyst.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M iss. (1981) J. Mol. Biol. 147(1); 195-7).

Concerning DUS1L polypeptides, Example 3 herein describes in Table C2 the percentage identity between the DUS1L polypeptide as represented by SEQ ID NO: 259 and the DUS1L polypeptides listed in Table A3, which can be as low as 32% amino acid sequence identity. In some instances, the default parameters may be adjusted to modify the stringency of the search. For example using BLAST, the statistical significance threshold (called "expect" value) for reporting matches against database sequences may be increased to show less stringent matches. This way, short nearly exact matches may be identified.

BET1-like polypeptides, when expressed in rice according to the methods of the present invention as outlined in the Examples section, give plants having increased yield related traits, in particular seed yield.

Additionally, BET1-like polypeptides may display a preferred subcellular localization, typically one or more of nuclear, cytoplasmic, chloroplastic, or mitochondrial. The task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, and others.

BET1-like polypeptide preferably comprises a transmembrane signal peptide which is typically located at the N-terminus. Transmembrane signal peptides are known in the art. Preferably BET1-like polypeptides are preferably localized in a membranous structure of the cell, most preferably at the endosperm transfer layer. Methods to determine the cellular subcelullar location of a protein are well known in the art.

Furthermore, CRT polypeptides typically have calcium (Ca2+) binding activity. Tools and techniques for measuring calcium (Ca2+) binding activity are well known in the art. For example the binding of a protein to calcium (Ca2+) may be determined in 45Ca2+ overlays of protein blots or by means of (3H)Bradykinin binding assay and/or fluorescence Ca2+ measurements of mouse embryonic fibroblasts assays as described by Christensen et al Plant Cell Phys. 2008, 49(6) 912-24. Alternatively CRT polypeptide activity may be assay in complementation of the Atcrt1a mutant as described by Christiansen et al. 2008. In addition, CRT polypeptides, when expressed in rice according to the methods of the present invention as outlined in the Example section, give plants having increased yield related traits, in particular.

Concerning DUS1L polypeptides, the task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, and others. The predicted subcellular localisation of SEQ ID NO: 259 using the PSort algorithm is the mitochondrial compartment (see Example 5).

Furthermore, ES43-like polypeptides typically have protein-protein interaction activity. Tools and techniques for measuring protein-protein interaction activity are well known in the art such as Co-immunoprecipitation, Bimolecular Fluorescence Complementation (BiFC), Fluorescence resonance energy transfer (FRET), Pull-down assays, Label transfer, the yeast two-hybrid screen, In-vivo crosslinking, Tandem affinity purification (TAP), Chemical crosslinking, Quantitative immunoprecipitation combined with knock-down (QUICK), Dual Polarisation Interferometry (DPI), Protein-protein docking, # Static Light Scattering (SLS), Chemical crosslinking followed by high mass MALDI mass spectrometry, SPINE (Strep-protein interaction experiment) and Surface plasmon resonance (Wikipedia).

In addition, ES43-like polypeptides, when expressed in rice according to the methods of the present invention as outlined in the Examples section, give plants having increased yield related traits, in particular increased seed filing rate.

Furthermore, HON5-like polypeptides typically have DNA binding and/or protein binding activity. Tools and techniques for measuring DNA binding, chromatin interaction and/or protein binding activity are well known in the art, including for example electrophoretic mobility shift assays and footprinting studies of the interaction with A/T-rich stretch frequently occurring in plant promoter regions (Gasser 2003, Plant Mol Biol. 53(3):281-95 and references therein; Pedersen et al., 1991; Nieto-Sotelo et al. 1994 Plant Cell 6: 287-301; Zhang et al. 2003 Biochemistry 42: 6596-6607; Klosterman 2002 Plant Science 162, 855-866).

In addition, HON5-like polypeptides, when expressed in rice according to the methods of the present invention as outlined in the Examples section give plants having increased yield related traits, in particular an increase in any one or more of total seed weight, number of filled seeds, increase of seed filling rate and harvest index.

Additionally, HON5-like polypeptides may display a preferred subcellular localization, typically one or more of nuclear, citoplasmic, chloroplastic, or mitochondrial. The task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, and others.

GSA1 polypeptides, when expressed in rice according to the methods of the present invention as outlined in the Examples section, give plants having increased yield related traits, in particular increased seed yield.

Concerning BET1-like polypeptides, the present invention is illustrated by transforming plants with the nucleic acid sequence represented by SEQ ID NO: 1, encoding the polypeptide sequence of SEQ ID NO: 2. However, performance of the invention is not restricted to these sequences; the methods of the invention may advantageously be performed using any BET1-like-encoding nucleic acid or BET1-like polypeptide as defined herein.

Examples of nucleic acids encoding BET1-like polypeptides are given in Table A1 of the Examples section herein. Such nucleic acids are useful in performing the methods of the invention. The amino acid sequences given in Table A1 of the Examples section are example sequences of orthologues and paralogues of the BET1-like polypeptide represented by SEQ ID NO: 2, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A1 of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 1 or SEQ ID NO: 2, the second BLAST would therefore be against corn sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning Calreticulin polypeptides, the present invention is illustrated by transforming plants with the nucleic acid sequence represented by SEQ ID NO: 104, encoding the polypeptide sequence of SEQ ID NO: 105. However, performance of the invention is not restricted to these sequences; the methods of the invention may advantageously be performed using any Calreticulin-encoding nucleic acid or Calreticulin polypeptide as defined herein.

Examples of nucleic acids encoding Calreticulin polypeptides are given in Table A2 of the Examples section herein. Such nucleic acids are useful in performing the methods of the invention. The amino acid sequences given in Table A2 of the Examples section are example sequences of orthologues and paralogues of the Calreticulin polypeptides represented by SEQ ID NO: 105, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A2 of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 104 or SEQ ID NO: 105, the second BLAST would therefore be against *Solanum* lycopersicum sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning DUS1L polypeptides, the present invention is illustrated by transforming plants with the nucleic acid sequence represented by SEQ ID NO: 258, encoding the DUS1L polypeptide sequence of SEQ ID NO: 259. However, performance of the invention is not restricted to these sequences; the methods of the invention may advantageously be performed using any nucleic acid sequence encoding a DUS1L polypeptide as defined herein.

Examples of nucleic acid sequences encoding DUS1L polypeptides are given in Table A3 of the Examples section herein. Such nucleic acid sequences are useful in performing the methods of the invention. The polypeptide sequences given in Table A3 of the Examples section are example sequences of orthologues and paralogues of the DUS1L polypeptide represented by SEQ ID NO: 259, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A3 of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 258 or SEQ ID NO: 259, the second BLAST would therefore be against *Saccharum officinarum* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning ES43-like polypeptides, the present invention is illustrated by transforming plants with the nucleic acid sequence represented by SEQ ID NO: 298, encoding the polypeptide sequence of SEQ ID NO: 299. However, performance of the invention is not restricted to these sequences; the methods of the invention may advantageously be performed using any ES43-like-encoding nucleic acid or ES43-like polypeptide as defined herein.

Examples of nucleic acids encoding ES43-like polypeptides are given in Table A4 of the Examples section herein. Such nucleic acids are useful in performing the methods of the invention. The amino acid sequences given in Table A4 of the Examples section are example sequences of orthologues and paralogues of the ES43-like polypeptide represented by SEQ ID NO: 299, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A4 of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 298 or SEQ ID NO: 299, the second BLAST would therefore be against rice sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning HON5-like polypeptides, the present invention is illustrated by transforming plants with the nucleic acid sequence represented by SEQ ID NO: 387, encoding the polypeptide sequence of SEQ ID NO: 388. However, performance of the invention is not restricted to these sequences; the methods of the invention may advantageously be performed using any HON5-like-encoding nucleic acid or HON5-like polypeptide as defined herein.

Examples of nucleic acids encoding HON5-like polypeptides are given in Table A5 of the Examples section herein. Such nucleic acids are useful in performing the methods of the invention. The amino acid sequences given in Table A5 of the Examples section are example sequences of orthologues and paralogues of the HON5-like polypeptide represented by SEQ ID NO: 388, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A5 of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 387 or SEQ ID NO: 388, the second BLAST would therefore be against *Populus trichocarpa* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning HON5-like polypeptides, the present invention is illustrated by transforming plants with the nucleic acid sequence represented by SEQ ID NO: 417, encoding the polypeptide sequence of SEQ ID NO: 418. However, performance of the invention is not restricted to these sequences; the methods of the invention may advantageously be performed using any GSA1-encoding nucleic acid or GSA1 polypeptide as defined herein.

Examples of nucleic acids encoding GSA1 polypeptides are given in Table A6 of the Examples section herein. Such nucleic acids are useful in performing the methods of the invention. The amino acid sequences given in Table A6 of the Examples section are example sequences of orthologues and paralogues of the GSA1 polypeptide represented by SEQ ID NO: 418, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A6 of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 417 or SEQ ID NO: 418, the second BLAST would therefore be against *Populus* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, Clustal W may be used, followed by a neighbour joining tree, to help visualize clustering of related genes and to identify orthologues and paralogues.

Nucleic acid variants may also be useful in practising the methods of the invention. Examples of such variants include nucleic acids encoding homologues and derivatives of any one of the amino acid sequences given in Table A1 to A6 of the Examples section, the terms "homologue" and "derivative" being as defined herein. Also useful in the methods of the invention are nucleic acids encoding homologues and derivatives of orthologues or paralogues of any one of the amino acid sequences given in Table A1 to A6 of the Examples section. Homologues and derivatives useful in the methods of the present invention have substantially the same biological and functional activity as the unmodified protein from which they are derived.

Further nucleic acid variants useful in practising the methods of the invention include portions of nucleic acids encoding BET1-like polypeptides, or Calreticulin polypeptides, or DUS1L polypeptides, or ES43-like polypeptides, or HON5-like polypeptides, or GSA1 polypeptides, nucleic acids hybridising to nucleic acids encoding BET1-like polypeptides, or Calreticulin polypeptides, or DUS1L polypeptides, or ES43-like polypeptides, or HON5-like polypeptides, or GSA1 polypeptides, splice variants of nucleic acids encoding BET1-like polypeptides, allelic variants of nucleic acids encoding BET1-like polypeptides, or Calreticulin polypeptides, or DUS1L polypeptides, or ES43-like polypeptides, or HON5-like polypeptides, or GSA1 polypeptides, and variants of nucleic acids encoding BET1-like polypeptides, or Calreticulin polypeptides, or DUS1L polypeptides, or ES43-like polypeptides, or HON5-like polypeptides, or GSA1 polypeptides, obtained by gene shuffling. The terms hybridising sequence, splice variant, allelic variant and gene shuffling are as described herein.

Nucleic acids encoding BET1-like polypeptides, or Calreticulin polypeptides, or DUS1L polypeptides, or ES43-like polypeptides, or HON5-like polypeptides, or GSA1 polypeptides, need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table A1 to A6 of the Examples section, or a portion of a nucleic acid encoding an orthologue, paralogue or homologue of any of the amino acid sequences given in Table A1 to A6 of the Examples section.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Concerning BET1-like polypeptides, portions useful in the methods of the invention, encode a BET1-like polypeptide as defined herein, and have substantially the same biological activity as the amino acid sequences given in Table A1 of the Examples section. Preferably, the portion is a portion of any one of the nucleic acids given in Table A1 of the Examples section, or is a portion of a nucleic acid encoding an orthologue or paralogue of any one of the amino acid sequences given in Table A1 of the Examples section. Preferably the portion is at least 50, 75, 100, 150, 200, or more consecutive nucleotides in length, the consecutive nucleotides being of any one of the nucleic acid sequences given in Table A1 of the Examples section, or of a nucleic acid encoding an orthologue or paralogue of any one of the amino acid sequences given in Table A1 of the Examples section. Most preferably the portion is a portion of the nucleic acid of SEQ ID NO: 1. Preferably, the portion encodes a fragment of an amino acid sequence comprising domain CC, preferably motif1 and/or 2 as defined above and having preferably at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO: 2.

Concerning Calreticulin polypeptides, portions useful in the methods of the invention, encode a Calreticulin polypeptide as defined herein, and have substantially the same biological activity as the amino acid sequences given in Table A2 of the Examples section. Preferably, the portion is a portion of any one of the nucleic acids given in Table A2 of the Examples section, or is a portion of a nucleic acid encoding an orthologue or paralogue of any one of the amino acid sequences given in Table A2 of the Examples section. Preferably the portion is at least 100, 200, 300, 400, 500, 550, 600, 650, 700, 750, 800, 850, 900, 950, 1000, 1150, 1200, 1250, 1300, 1350, 1400, 1450, 1500, 1550, 1600, 1650, 1700, 1750, 1800, 1850, 1900, or more consecutive nucleotides in length, the consecutive nucleotides being of any one of the nucleic acid sequences given in Table A2 of the Examples section, or of a nucleic acid encoding an orthologue or paralogue of any one of the amino acid sequences given in Table A2 of the Examples section. Most preferably the portion is a portion of the nucleic acid of SEQ ID NO: 104. Preferably, the portion encodes a fragment of an amino acid sequence which, when used in the construction of a phylogenetic tree, such as the one depicted in Christensen et al. 2008-FIG. 1 and herein reproduced in FIG. 5, clusters with the group of At_CRT1a or At_CRT1b, Os_CRT1a or Os_CRT1b, and Os_CRT3 or At_CRT3 polypeptides, preferably with the group of At_CRT1a or At_CRT1b, Os_CRT1a or Os_CRT1b. Alternatively, the portion encodes a fragment of an amino acid sequence which, when used in the construction of a phylogenetic tree, such as the one described in Example 2 cluster with any one of the polypeptide within the following phylogenetic classes: class 1-CRT1,2-CRT3,3-algae, 4-animal and 5-protist of Example 2, preferably with the class 1-CRT1 polypeptides.

Concerning DUS1L polypeptides, portions useful in the methods of the invention, encode a DUS1L polypeptide as defined herein, and have substantially the same biological activity as the polypeptide sequences given in Table A3 of the Examples section. Preferably, the portion is a portion of any one of the nucleic acid sequences given in Table A3 of the Examples section, or is a portion of a nucleic acid sequence encoding an orthologue or paralogue of any one of the polypeptide sequences given in Table A3 of the Examples section. Preferably the portion is, in increasing order of preference at least 700, 800, 900, 1000, 1100, 1150, 1200, 1250, 1300, 1350, 1400 or more consecutive nucleotides in length, the consecutive nucleotides being of any one of the nucleic acid sequences given in Table A3 of the Examples section, or of a nucleic acid sequence encoding an orthologue or paralogue of any one of the polypeptide sequences given in Table A3 of the Examples section. Preferably, the portion is a portion of a nucleic sequence encoding a polypeptide sequence comprising in increasing order of preference at least 50%, 55%, 60%, 65%, 70%, 75%, 80%, 85%, 90%, 95%, 98%, 99% or more amino acid sequence identity to a tRNA-dihydrouridine synthase domain as represented by SEQ ID NO: 294. More preferably, the portion is a portion of a nucleic sequence encoding a polypeptide sequence comprising in increasing order of preference at least 30%, 35%, 40%, 45%, 50%, 55%, 60%, 65%, 70%, 75%, 80%, 85%, 90%, 95%, 98%, 99% or more amino acid sequence identity to the DUS1L polypeptide as represented by SEQ ID NO: 259 or to any of the polypeptide sequences given in Table A3 herein. Most preferably, the portion is a portion of the nucleic acid sequence of SEQ ID NO: 258.

Concerning ES43-like polypeptides, portions useful in the methods of the invention, encode an ES43-like polypeptide as defined herein, and have substantially the same biological activity as the amino acid sequences given in Table A4 of the Examples section. Preferably, the portion is a portion of any one of the nucleic acids given in Table A4 of the Examples section, or is a portion of a nucleic acid encoding an orthologue or paralogue of any one of the amino acid sequences given in Table A4 of the Examples section. Preferably the portion is at least 100, 200, 300, 400, 500, 550, 600, 650, 700, or more consecutive nucleotides in length, the consecutive nucleotides being of any one of the nucleic acid sequences given in Table A4 of the Examples section, or of a nucleic acid encoding an orthologue or paralogue of any one of the amino acid sequences given in Table A4 of the Examples section. Most preferably the portion is a portion of the nucleic acid of SEQ ID NO: 298. Preferably, the portion encodes a fragment of an amino acid sequence which comprises a BAH domain or a PHD domain or both.

Concerning HON5-like polypeptides, portions useful in the methods of the invention, encode a HON5-like polypeptide as defined herein, and have substantially the same biological activity as the amino acid sequences given in Table A5 of the Examples section. Preferably, the portion is a portion of any one of the nucleic acids given in Table A5 of the Examples section, or is a portion of a nucleic acid encoding an orthologue or paralogue of any one of the amino acid sequences given in Table A5 of the Examples section. Preferably the portion is at least 100, 200, 300, 400, 500, 600, 700, 800, 900, 1000, 1100, 1200, 1300, 1400, 1500, 1600, 1700, 1800, 1900, 2000, 2100, 2200, 2300, 2400, 2500, 2600, 2700, 2800, or more consecutive nucleotides in length, the consecutive nucleotides being of any one of the nucleic acid sequences given in Table A5 of the Examples section, or of a nucleic acid encoding an orthologue or paralogue of any one of the amino acid sequences given in Table A5 of the Examples section. Most preferably the portion is a portion of the nucleic acid of SEQ ID NO: 387. Preferably, the portion encodes a fragment of an amino acid sequence which comprises any one or more of the Motifs I, II or III as outline above.

Concerning GSA1 polypeptides, portions useful in the methods of the invention, encode a GSA1 polypeptide as defined herein, and have substantially the same biological activity as the amino acid sequences given in Table A6 of the Examples section. Preferably, the portion is a portion of any one of the nucleic acids given in Table A6 of the Examples section, or is a portion of a nucleic acid encoding an orthologue or paralogue of any one of the amino acid sequences given in Table A6 of the Examples section. Preferably the portion is at least 500, 550, 600, 650, 700, 750, 800, 850, 900, 950, 1000, 1050, 1100, 1150, 1200, 1250, 1300, 1350, 1400, or more consecutive nucleotides in length, the consecutive nucleotides being of any one of the nucleic acid sequences given in Table A6 of the Examples section, or of a nucleic acid encoding an orthologue or paralogue of any one of the amino acid sequences given in Table A6 of the Examples section. Most preferably the portion is a portion of the nucleic acid of SEQ ID NO: 417. Preferably, the portion encodes a fragment of an amino acid sequence which, when used in the construction of a phylogenetic tree, such as the one depicted in FIG. 17, clusters with the group of GSA1 polypeptides comprising the amino acid sequence represented by SEQ ID NO: 418 rather than with any other group.

Another nucleic acid variant useful in the methods of the invention is a nucleic acid capable of hybridising, under reduced stringency conditions, preferably under stringent conditions, with a nucleic acid encoding a BET1-like polypeptide, or a Calreticulin polypeptide, or a DUS1L polypeptide, or an ES43-like polypeptide, or a HON5-like polypeptide, or a GSA1 polypeptide, as defined herein, or with a portion as defined herein.

According to the present invention, there is provided a method for enhancing yield-related traits in plants, comprising introducing and expressing in a plant a nucleic acid capable of hybridizing to any one of the nucleic acids given in Table A1 to A6 of the Examples section, or comprising introducing and expressing in a plant a nucleic acid capable of hybridising to a nucleic acid encoding an orthologue, paralogue or homologue of any of the nucleic acid sequences given in Table A1 to A6 of the Examples section.

Concerning BET1-like polypeptides, hybridising sequences useful in the methods of the invention encode a BET1-like polypeptide as defined herein, having substantially the same biological activity as the amino acid sequences given in Table A1 of the Examples section. Preferably, the hybridising sequence is capable of hybridising to the complement of any one of the nucleic acids given in Table A1 of the Examples section, or to a portion of any of these sequences, a portion being as defined above, or the hybridising sequence is capable of hybridising to the complement of a nucleic acid encoding an orthologue or paralogue of any one of the amino acid sequences given in Table A1 of the Examples section. Most preferably, the hybridising sequence is capable of hybridising to the complement of a nucleic acid as represented by SEQ ID NO: 1 or to a portion thereof.

Another nucleic acid variant useful in the methods of the invention is a splice variant encoding a BET1-like polypeptide as defined hereinabove, a splice variant being as defined herein.

Concerning Calreticulin polypeptides, hybridising sequences useful in the methods of the invention encode a Calreticulin polypeptide as defined herein, having substantially the same biological activity as the amino acid sequences given in Table A2 of the Examples section. Preferably, the hybridising sequence is capable of hybridising to the complement of any one of the nucleic acids given in Table A2 of the Examples section, or to a portion of any of these sequences, a portion being as defined above, or the hybridising sequence is capable of hybridising to the complement of a nucleic acid encoding an orthologue or paralogue of any one of the amino acid sequences given in Table A2 of the Examples section. Most preferably, the hybridising sequence is capable of hybridising to the complement of a nucleic acid as represented by SEQ ID NO: 104 or to a portion thereof.

Preferably, the hybridising sequence encodes a polypeptide with an amino acid sequence which, when full-length and used in the construction of a phylogenetic tree, such as the one depicted in Christensen et al. 2008-FIG. 1 and herein reproduced in FIG. 5, clusters with the group of At_CRT1a or At_CRT1b, Os_CRT1a or Os_CRT1b, and Os_CRT3 or At_CRT3 polypeptides, preferably with the group of At_CRT1a or At_CRT1b, Os_CRT1a or Os_CRT1b. Alternatively, the hybridising sequence encodes a polypeptide sequence which, when used in the construction of a phylogenetic tree, such as the one described in Example 2 clusters with any one of the polypeptides within the following phylogenetic classes: class 1-CRT1,2-CRT3,3-algae, 4-animal and 5-protist of Example 2, preferably with the class 1-CRT1 polypeptides.

Concerning DUSL1 polypeptides, hybridising sequences useful in the methods of the invention encode a DUS1L polypeptide as defined herein, and have substantially the same biological activity as the polypeptide sequences given in Table A3 of the Examples section. Preferably, the hybridising sequence is capable of hybridising to any one of the nucleic acid sequences given in Table A3 of the Examples section, or to a complement thereof, or to a portion of any of these sequences, a portion being as defined above, or wherein the hybridising sequence is capable of hybridising to a nucleic acid sequence encoding an orthologue or paralogue of any one of the polypeptide sequences given in Table A3 of the Examples section, or to a complement thereof. Preferably, the hybridising sequence is capable of hybridising to a nucleic acid sequence encoding a polypeptide sequence comprising in increasing order of preference at least 50%, 55%, 60%, 65%, 70%, 75%, 80%, 85%, 90%, 95%, 98%, 99% or more amino acid sequence identity to a tRNA-dihydrouridine synthase domain as represented by SEQ ID NO: 294. More preferably, the hybridising sequence is capable of hybridising to a nucleic acid sequence encoding a polypeptide sequence comprising in increasing order of preference at least 30%, 35%, 40%, 45%, 50%, 55%, 60%, 65%, 70%, 75%, 80%, 85%, 90%, 95%, 98%, 99% or more amino acid sequence identity to the DUS1L polypeptide as represented by SEQ ID NO: 259 or to any of the polypeptide sequences given in Table A3 herein. Most preferably, the hybridising sequence is capable of hybridising to a nucleic acid sequence as represented by SEQ ID NO: 258 or to a portion thereof.

Concerning ES43-like polypeptides, hybridising sequences useful in the methods of the invention encode an ES43-like polypeptide as defined herein, having substantially the same biological activity as the amino acid sequences given in Table A4 of the Examples section. Preferably, the hybridising sequence is capable of hybridising to the complement of any one of the nucleic acids given in Table A4 of the Examples section, or to a portion of any of these sequences, a portion being as defined above, or the hybridising sequence is capable of hybridising to the complement of a nucleic acid encoding an orthologue or paralogue of any one of the amino acid sequences given in Table A4 of the Examples section. Most preferably, the hybridising sequence is capable of hybridising to the complement of a nucleic acid as represented by SEQ ID NO: 298 or to a portion thereof.

Preferably, the hybridising sequence encodes a polypeptide with an amino acid sequence which comprises a BAH or a PHD domain or both domains.

Concerning HON5-like polypeptides, hybridising sequences useful in the methods of the invention encode a HON5-like polypeptide as defined herein, having substantially the same biological activity as the amino acid sequences given in Table A5 of the Examples section. Preferably, the hybridising sequence is capable of hybridising to the complement of any one of the nucleic acids given in Table A5 of the Examples section, or to a portion of any of these sequences, a portion being as defined above, or the hybridising sequence is capable of hybridising to the complement of a nucleic acid encoding an orthologue or paralogue of any one of the amino acid sequences given in Table A5 of the Examples section. Most preferably, the hybridising sequence is capable of hybridising to the complement of a nucleic acid as represented by SEQ ID NO: 387 or to a portion thereof.

Preferably, the hybridising sequence encodes a polypeptide with an amino acid sequence which comprises any one or more of the Motifs I, II or III as outline above.

Concerning GSA1 polypeptides, hybridising sequences useful in the methods of the invention encode a GSA1 polypeptide as defined herein, having substantially the same biological activity as the amino acid sequences given in Table A6 of the Examples section. Preferably, the hybridising sequence is capable of hybridising to the complement of any one of the nucleic acids given in Table A6 of the Examples section, or to a portion of any of these sequences, a portion being as defined above, or the hybridising sequence is capable of hybridising to the complement of a nucleic acid encoding an orthologue or paralogue of any one of the amino acid sequences given in Table A6 of the Examples section. Most preferably, the hybridising sequence is capable of hybridising to the complement of a nucleic acid as represented by SEQ ID NO: 417 or to a portion thereof.

Preferably, the hybridising sequence encodes a polypeptide with an amino acid sequence which, when full-length and used in the construction of a phylogenetic tree, such as the one depicted in FIG. 17, clusters with the group of GSA1 polypeptides comprising the amino acid sequence represented by SEQ ID NO: 418 rather than with any other group.

Another nucleic acid variant useful in the methods of the invention is a splice variant encoding a BET1-like polypeptide, or a Calreticulin polypeptide, or a DUS1L polypeptide, or an ES43-like polypeptide, or a HON5-like polypeptide, or a GSA1 polypeptide, as defined hereinabove, a splice variant being as defined herein.

According to the present invention, there is provided a method for enhancing yield-related traits in plants, comprising introducing and expressing in a plant a splice variant of any one of the nucleic acid sequences given in Table A1 to A6 of the Examples section, or a splice variant of a nucleic acid encoding an orthologue, paralogue or homologue of any of the amino acid sequences given in Table A1 to A6 of the Examples section.

Concerning BET1-like polypeptides, preferred splice variants are splice variants of a nucleic acid represented by SEQ ID NO: 1, or a splice variant of a nucleic acid encoding an orthologue or paralogue of SEQ ID NO: 2 and/or any polypeptide having an amino acid sequence of a BET1-like polypeptide as defined above.

Concerning Calreticulin polypeptides, preferred splice variants are splice variants of a nucleic acid represented by SEQ ID NO: 104, or a splice variant of a nucleic acid encoding an orthologue or paralogue of SEQ ID NO: 105. Preferably, the amino acid sequence encoded by the splice variant, when used in the construction of a phylogenetic tree, such as the one depicted in Christensen et al. 2008-FIG. 1 and herein reproduced in FIG. 5, clusters with the group of At_CRT1a or At_CRT1b, Os_CRT1a or Os_CRT1b, and Os_CRT3 or At_CRT3 polypeptides, preferably with the group of At_CRT1a or At_CRT1b, Os_CRT1a or Os_CRT1b. Alternatively, the spliced variant encodes a polypeptide which, when used in the construction of a phylogenetic tree, such as the one described in Example 2 clusters with any one of the polypeptides within the following phylogenetic classes: class 1-CRT1,2-CRT3,3-algae, 4-animal and 5-protist of Example 2, preferably with the class 1-CRT1 polypeptides.

Concerning DUSL1 polypeptides, preferred splice variants are splice variants of a nucleic acid sequence represented by SEQ ID NO: 258, or a splice variant of a nucleic acid sequence encoding an orthologue or paralogue of SEQ ID NO: 259. Preferably, the splice variant is a splice variant of a nucleic acid sequence encoding a polypeptide sequence comprising in increasing order of preference at least 50%, 55%, 60%, 65%, 70%, 75%, 80%, 85%, 90%, 95%, 98%, 99% or more amino acid sequence identity to a tRNA-dihydrouridine synthase domain as represented by SEQ ID NO: 294. More preferably, the splice variant is a splice variant of a nucleic acid sequence encoding a polypeptide sequence comprising in increasing order of preference at least 30%, 35%, 40%, 45%, 50%, 55%, 60%, 65%, 70%, 75%, 80%, 85%, 90%, 95%, 98%, 99% or more amino acid sequence identity to the DUS1L polypeptide as represented by SEQ ID NO: 259 or to any of the polypeptide sequences given in Table A3 herein. Most preferably, the splice variant is a splice variant of a nucleic acid sequence as represented by SEQ ID NO: 258, or of a nucleic acid sequence encoding a polypeptide sequence as represented by SEQ ID NO: 259.

Concerning ES43-like polypeptides, preferred splice variants are splice variants of a nucleic acid represented by SEQ ID NO: 298, or a splice variant of a nucleic acid encoding an orthologue or paralogue of SEQ ID NO: 299. Preferably, the amino acid sequence encoded by the splice variant preferably comprises a BAH or a PHD domain or both domains.

Concerning HON5-like polypeptides, preferred splice variants are splice variants of a nucleic acid represented by SEQ ID NO: 387, or a splice variant of a nucleic acid encoding an orthologue or paralogue of SEQ ID NO: 388. Preferably, the amino acid sequence encoded by the splice variant comprises any one or more of the Motifs I, II or III as outline above.

Concerning GSA1 polypeptides, preferred splice variants are splice variants of a nucleic acid represented by SEQ ID NO: 417, or a splice variant of a nucleic acid encoding an orthologue or paralogue of SEQ ID NO: 418. Preferably, the amino acid sequence encoded by the splice variant, when used in the construction of a phylogenetic tree, such as the one depicted in FIG. 17, clusters with the group of GSA1 polypeptides comprising the amino acid sequence represented by SEQ ID NO: 418 rather than with any other group.

Another nucleic acid variant useful in performing the methods of the invention is an allelic variant of a nucleic acid encoding a BET1-like polypeptide, or a Calreticulin polypeptide, or a DUS1L polypeptide, or an ES43-like polypeptide, or a HON5-like polypeptide, or a GSA1 polypeptide, as defined hereinabove, an allelic variant being as defined herein.

According to the present invention, there is provided a method for enhancing yield-related traits in plants, comprising introducing and expressing in a plant an allelic variant of any one of the nucleic acids given in Table A of the Examples section, or comprising introducing and expressing in a plant an allelic variant of a nucleic acid encoding an orthologue, paralogue or homologue of any of the amino acid sequences given in Table A of the Examples section.

Concerning BET1-like polypeptides, the polypeptides encoded by allelic variants useful in the methods of the present invention have substantially the same biological activity as the BET1-like polypeptide of SEQ ID NO: 2 and any of the amino acids depicted in Table A1 of the Examples section. Allelic variants exist in nature, and encompassed within the methods of the present invention is the use of these natural alleles. Preferably, the allelic variant is an allelic variant of SEQ ID NO: 1 or an allelic variant of a nucleic acid encoding an orthologue or paralogue of SEQ ID NO: 2.

Concerning Calreticulin polypeptides, the polypeptides encoded by allelic variants useful in the methods of the present invention have substantially the same biological activity as the Calreticulin polypeptide of SEQ ID NO: 105 and any of the amino acids depicted in Table A2 of the Examples section. Allelic variants exist in nature, and encompassed within the methods of the present invention is the use of these natural alleles. Preferably, the allelic variant is an allelic variant of SEQ ID NO: 104 or an allelic variant of a nucleic acid encoding an orthologue or paralogue of SEQ ID NO: 105. Preferably, the amino acid sequence encoded by the allelic variant, when used in the construction of a phylogenetic tree, such as the one depicted in Christensen et al. 2008-FIG. 1 and herein reproduced in FIG. 5, clusters with the group of At_CRT1a or At_CRT1b, Os_CRT1a or Os_CRT1b, and Os_CRT3 or At_CRT3 polypeptides, preferably with the group of At_CRT1a or At_CRT1b, Os_CRT1a or Os_CRT1b. Alternatively, the allelic variant encodes a polypeptide which, when used in the construction of a phylogenetic tree, such as the one described in Example 2 clusters with any one of the polypeptides within the following phylogenetic classes: class 1-CRT1,2-CRT3,3-algae, 4-animal and 5-protist of Example 2, preferably with the class 1-CRT1 polypeptides.

Concerning DUSL1 polypeptides, the allelic variants useful in the methods of the present invention have substantially the same biological activity as the DUS1L polypeptide of SEQ ID NO: 259 and any of the polypeptide sequences depicted in Table A3 of The Examples section. Allelic variants exist in nature, and encompassed within the methods of the present invention is the use of these natural alleles. Preferably, the allelic variant is an allelic variant of a polypeptide sequence comprising in increasing order of preference at least 50%, 55%, 60%, 65%, 70%, 75%, 80%, 85%, 90%, 95%, 98%, 99% or more amino acid sequence identity to a tRNA-dihydrouridine synthase domain as represented by SEQ ID NO: 294. More preferably the allelic variant is an allelic variant encoding a polypeptide sequence comprising in increasing order of preference at least 30%, 35%, 40%, 45%, 50%, 55%, 60%, 65%, 70%, 75%, 80%, 85%, 90%, 95%, 98%, 99% or more amino acid sequence identity to the DUS1L polypeptide as represented by SEQ ID NO: 259 or to any of the polypeptide sequences given in Table A3 herein. Most preferably, the allelic variant is an allelic variant of SEQ ID NO: 258 or an allelic variant of a nucleic acid sequence encoding an orthologue or paralogue of SEQ ID NO: 259.

Concerning ES43-like polypeptides, the polypeptides encoded by allelic variants useful in the methods of the present invention have substantially the same biological activity as the ES43-like polypeptide of SEQ ID NO: 299 and any of the amino acids depicted in Table A4 of the Examples section. Allelic variants exist in nature, and encompassed within the methods of the present invention is the use of these natural alleles. Preferably, the allelic variant is an allelic variant of SEQ ID NO: 298 or an allelic variant of a nucleic acid encoding an orthologue or paralogue of SEQ ID NO: 299. Preferably, the amino acid sequence encoded by the allelic variant comprises a BAH or a PHD domain or both domains.

Concerning HON5-like polypeptides, the polypeptides encoded by allelic variants useful in the methods of the present invention have substantially the same biological activity as the HON5-like polypeptide of SEQ ID NO: 388 and any of the amino acids depicted in Table A5 of the Examples section. Allelic variants exist in nature, and encompassed within the methods of the present invention is the use of these natural alleles. Preferably, the allelic variant is an allelic variant of SEQ ID NO: 387 or an allelic variant of a nucleic acid encoding an orthologue or paralogue of SEQ ID NO: 388. Preferably, the amino acid sequence encoded by the allelic variant comprises any one or more of the Motifs I, II or III as outline above.

Concerning GSA1 polypeptides, the polypeptides encoded by allelic variants useful in the methods of the present invention have substantially the same biological activity as the GSA1 polypeptide of SEQ ID NO: 418 and any of the amino acids depicted in Table A6 of the Examples section. Allelic variants exist in nature, and encompassed within the methods of the present invention is the use of these natural alleles. Preferably, the allelic variant is an allelic variant of SEQ ID NO: 417 or an allelic variant of a nucleic acid encoding an orthologue or paralogue of SEQ ID NO: 418. Preferably, the amino acid sequence encoded by the allelic variant, when used in the construction of a phylogenetic tree, such as the one depicted in FIG. 17, clusters with the GSA1 polypeptides comprising the amino acid sequence represented by SEQ ID NO: 418 rather than with any other group.

Gene shuffling or directed evolution may also be used to generate variants of nucleic acids encoding BET1-like polypeptides, or Calreticulin polypeptides, or DUS1L polypeptides, or ES43-like polypeptides, or HON5-like polypeptides, or GSA1 polypeptides, as defined above; the term "gene shuffling" being as defined herein.

According to the present invention, there is provided a method for enhancing yield-related traits in plants, comprising introducing and expressing in a plant a variant of any one of the nucleic acid sequences given in Table A1 to A6 of the Examples section, or comprising introducing and expressing in a plant a variant of a nucleic acid encoding an orthologue, paralogue or homologue of any of the amino acid sequences given in Table A1 to A6 of the Examples section, which variant nucleic acid is obtained by gene shuffling.

Concerning BET1-like polypeptides, preferably, the amino acid sequence encoded by the variant nucleic acid is obtained by gene shuffling.

Concerning Calreticulin polypeptides, preferably, the amino acid sequence encoded by the variant nucleic acid obtained by gene shuffling, when used in the construction of a phylogenetic tree, such as the one depicted in Christensen et al. 2008-FIG. 1 and herein reproduced in FIG. 5, clusters with the group of At_CRT1a or At_CRT1b, Os_CRT1a or Os_CRT1b, and Os_CRT3 or At_CRT3 polypeptides, preferably with the group of At_CRT1a or At_CRT1b, Os_CRT1a or Os_CRT1b. Alternatively, the variant nucleic acid encodes a polypeptide which, when used in the construction of a phylogenetic tree, such as the one described in Example 2 clusters with any one of the polypeptides within the following phylogenetic classes: class 1-CRT1,2-CRT3,3-algae, 4-animal and 5-protist of Example 2, preferably with the class 1-CRT1 polypeptides.

Concerning DUSL1 polypeptides, preferably, the variant nucleic acid sequence obtained by gene shuffling encodes a polypeptide sequence comprising in increasing order of preference at least 50%, 55%, 60%, 65%, 70%, 75%, 80%, 85%, 90%, 95%, 98%, 99% or more amino acid sequence identity to a tRNA-dihydrouridine synthase domain as represented by SEQ ID NO: 294. More preferably, the variant nucleic acid sequence obtained by gene shuffling encodes a polypeptide sequence comprising in increasing order of preference at least 30%, 35%, 40%, 45%, 50%, 55%, 60%, 65%, 70%, 75%, 80%, 85%, 90%, 95%, 98%, 99% or more amino acid sequence identity to the DUS1L polypeptide as represented by SEQ ID NO: 259 or to any of the polypeptide sequences given in Table A3 herein. Most preferably, the nucleic acid sequence obtained by gene shuffling encodes a polypeptide sequence as represented by SEQ ID NO: 259.

Concerning ES43-like polypeptides, preferably, the amino acid sequence encoded by the variant nucleic acid obtained by gene shuffling, which preferably encode a protein which comprises a BAH or a PHD domain or both domains.

Concerning HONE-like polypeptides, preferably, the amino acid sequence encoded by the variant nucleic acid obtained by gene shuffling comprises any one or more of the Motifs I, II or III as outline above.

Concerning GSA1 polypeptides, preferably, the amino acid sequence encoded by the variant nucleic acid obtained by gene shuffling, when used in the construction of a phylogenetic tree such as the one depicted in FIG. 17, clusters with the group of GSA1 polypeptides comprising the amino acid sequence represented by SEQ ID NO: 418 rather than with any other group.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding BET1-like polypeptides may be derived from any natural or artificial source. The nucleic acid may be modified from its native form in composition and/or genomic environment through deliberate human manipulation. Preferably the BET1-like polypeptide-encoding nucleic acid is from a plant, further preferably from a monocotyledonous plant, more preferably from the family Poaceae, most preferably the nucleic acid is from *Zea mays*.

Nucleic acids encoding Calreticulin polypeptides may be derived from any natural or artificial source. The nucleic acid may be modified from its native form in composition and/or genomic environment through deliberate human manipulation. Preferably the Calreticulin polypeptides-encoding nucleic acid is from a plant, further preferably from a dicotyledonous plant, more preferably from the family Solanaceae or from the family Salicaceae, in particular from *Populus* species, most preferably the nucleic acid is from *Solanum lycopersicum* or from *Populus trichocarpa*.

Nucleic acid sequences encoding DUS1L polypeptides may be derived from any natural or artificial source. The nucleic acid sequence may be modified from its native form in composition and/or genomic environment through deliberate human manipulation. The nucleic acid sequence encoding a DUS1L polypeptide is from an algae. The nucleic acid sequence encoding a DUS1L polypeptide is from a plant, further preferably from a monocotyledonous plant, more preferably from the family Poaceae, most preferably the nucleic acid sequence is from *Saccharum officinarum*.

Nucleic acids encoding ES43-like polypeptides may be derived from any natural or artificial source. The nucleic acid may be modified from its native form in composition and/or genomic environment through deliberate human manipulation. Preferably the ES43-like polypeptide-encoding nucleic acid is from a plant, further preferably from a monocotyledonous plant, more preferably from the family Poaceae, most preferably the nucleic acid is from *Oryza sativa*.

Nucleic acids encoding HON5-like polypeptides may be derived from any natural or artificial source. The nucleic acid may be modified from its native form in composition and/or genomic environment through deliberate human manipulation. Preferably the HON5-like polypeptide-encoding nucleic acid is from a plant, further preferably from a dicotyledonous plant, more preferably from the family Salicaceae, most preferably the nucleic acid is from *Populus trichocarpa*.

Nucleic acids encoding GSA1 polypeptides may be derived from any natural or artificial source. The nucleic acid may be modified from its native form in composition and/or genomic environment through deliberate human manipulation. Preferably the GSA1 polypeptide-encoding nucleic acid is from a plant, further preferably from a monocotyledonous or dicotyledonous plant, more preferably from *Populus*.

Performance of the methods of the invention gives plants having enhanced yield-related traits. In particular performance of the methods of the invention gives plants having increased yield, especially increased seed yield relative to control plants. The terms "yield" and "seed yield" are described in more detail in the "definitions" section herein.

Reference herein to enhanced yield-related traits is taken to mean an increase in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of control plants.

Taking corn as an example, a yield increase may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per square meter, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing yield, especially seed yield of plants, relative to control plants, which method comprises modulating expression in a plant of a nucleic acid encoding a BET1-like polypeptide, or a Calreticulin polypeptide, or a DUS1L polypeptide, or an ES43-like polypeptide, or a HON5-like polypeptide, or a GSA1 polypeptide, as defined herein.

Since the transgenic plants according to the present invention have increased yield and/or yield-related traits, it is likely that these plants exhibit an increased growth rate (during at least part of their life cycle), relative to the growth rate of control plants at a corresponding stage in their life cycle.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect increased (early) vigour. The increase in growth rate may alter the harvest cycle of a plant allowing plants to be sown later and/or harvested sooner than would otherwise be possible (a similar effect may be obtained with earlier flowering time; delayed flowering is usually not a desirede trait in crops). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises modulating expression in a plant of a nucleic acid encoding a BET1-like polypeptide, or a Calreticulin polypeptide, or a DUS1L polypeptide, or an ES43-like polypeptide, or a HON5-like polypeptide, or a GSA1 polypeptide, as defined herein.

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35%, 30% or 25%, more preferably less than 20% or 15% in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi, nematodes and insects. Biotic stresses are typically those stresses caused by pathogens, such as bacteria, viruses, fungi, nematodes, and insects. The term "non-stress" conditions as used herein are those environmental conditions that allow optimal growth of plants. Persons skilled in the art are aware of normal soil conditions and climatic conditions for a given location. The term non-stress conditions as used herein, encompasses the occasional or everyday mild stresses to which a plant is exposed, as defined herein, but does not encompass severe stresses.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location. Plants with optimal growth conditions, (grown under non-stress conditions) typically yield in increasing order of preference at least 97%, 95%, 92%, 90%, 87%, 85%, 83%, 80%, 77% or 75% of the average production of such plant in a given environment. Average production may be calculated on harvest and/or season basis. Persons skilled in the art are aware of average yield productions of a crop.

The term "abiotic stress" as defined herein is taken to mean any one or more of: water stress (due to drought or excess water), anaerobic stress, salt stress, temperature stress (due to hot, cold or freezing temperatures), chemical toxicity stress and oxidative stress. According to one aspect of the invention, the abiotic stress is an osmotic stress, selected from water stress, salt stress, oxidative stress and ionic stress. Preferably, the water stress is drought stress. The term salt stress is not restricted to common salt (NaCl), but may be any stress caused by one or more of: NaCl, KCl, LiCl, $MgCl_2$, $CaCl_2$, amongst others.

Performance of the methods of the invention gives plants grown under non-stress conditions or under mild drought conditions increased yield relative to control plants grown under comparable conditions. Therefore, according to the present invention, there is provided a method for increasing yield and/yield-related traits in plants grown under non-stress conditions or under mild drought conditions, which method comprises modulating expression in a plant of a nucleic acid encoding a BET1-like polypeptide, or a Calreticulin polypeptide, or a DUS1L polypeptide, or an ES43-like polypeptide, or a HON5-like polypeptide, or a GSA1 polypeptide.

Concerning DUSL1 polypeptides, performance of the methods of the invention gives plants having increased yield-related traits, under abiotic stress conditions relative to control plants grown in comparable stress conditions. Therefore, according to the present invention, there is provided a method for increasing yield-related traits, in plants grown under abiotic stress conditions, which method comprises increasing expression in a plant of a nucleic acid sequence encoding a DUS1L polypeptide. According to one aspect of the invention, the abiotic stress is an osmotic stress, selected from one or more of the following: water stress, salt stress, oxidative stress and ionic stress.

Another example of abiotic environmental stress is the reduced availability of one or more nutrients that need to be assimilated by the plants for growth and development. Because of the strong influence of nutrition utilization efficiency on plant yield and product quality, a huge amount of fertilizer is poured onto fields to optimize plant growth and quality. Productivity of plants ordinarily is limited by three primary nutrients, phosphorous, potassium and nitrogen, which is usually the rate-limiting element in plant growth of these three. Therefore the major nutritional element required for plant growth is nitrogen (N). It is a constituent of numerous important compounds found in living cells, including amino acids, proteins (enzymes), nucleic acids, and chlorophyll. 1.5% to 2% of plant dry matter is nitrogen and approximately 16% of total plant protein. Thus, nitrogen availability is a major limiting factor for crop plant growth and production (Frink et al. (1999) Proc Natl Acad Sci USA 96(4): 1175-1180), and has as well a major impact on protein accumulation and amino acid composition. Therefore, of great interest are crop plants with increased yield-related traits, when grown under nitrogen-limiting conditions.

Performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding a BET1-like polypeptide, or a Calreticulin polypeptide, or a DUS1L polypeptide, or an ES43-like polypeptide, or a HON5-like polypeptide, or a GSA1 polypeptide. Nutrient deficiency may result from a lack of nutrients such as nitrogen, phosphates and other phosphorous-containing compounds, potassium, calcium, magnesium, manganese, iron and boron, amongst others.

Performance of the methods of the invention gives plants grown under conditions of salt stress, increased yield relative to control plants grown under comparable conditions. Therefore, according to the present invention, there is provided a method for increasing yield in plants grown under conditions of salt stress, which method comprises modulating expression in a plant of a nucleic acid encoding a BET1-like polypeptide, or a Calreticulin polypeptide, or an ES43-like polypeptide, or a HON5-like polypeptide, or a GSA1 polypeptide. The term salt stress is not restricted to common salt (NaCl), but may be any one or more of: NaCl, KCl, LiCl, $MgCl_2$, $CaCl_2$, amongst others.

The present invention encompasses plants or parts thereof (including seeds) obtainable by the methods according to the present invention. The plants or parts thereof comprise a nucleic acid transgene encoding a BET1-like polypeptide, or a Calreticulin polypeptide, or a DUS1L polypeptide, or an ES43-like polypeptide, or a HON5-like polypeptide, or a GSA1 polypeptide, as defined above, operably linked to a promoter functioning in plants.

The invention also provides genetic constructs and vectors to facilitate introduction and/or expression in plants of nucleic acids encoding BET1-like polypeptides, or Calreticulin polypeptides, or DUS1L polypeptides, or ES43-like polypeptides, or HON5-like polypeptides, or GSA1 polypeptides. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
(a) a nucleic acid encoding a BET1-like polypeptide, or a Calreticulin polypeptide, or a DUS1L polypeptide, or an ES43-like polypeptide, or a HON5-like polypeptide, or a GSA1 polypeptide, as defined above;
(b) one or more control sequences capable of driving expression of the nucleic acid sequence of (a); and optionally
(c) a transcription termination sequence.

Preferably, the nucleic acid encoding a BET1-like polypeptide, or a Calreticulin polypeptide, or a DUS1L polypeptide, or an ES43-like polypeptide, or a HON5-like polypeptide, or a GSA1 polypeptide, is as defined above. The term "control sequence" and "termination sequence" are as defined herein.

Concerning DUS1L polypeptides, one of the control sequences of a construct is preferably a consitituve promoter isolated from a plant genome. An example of a constitutive promoter is a GOS2 promoter, preferably a GOS2 promoter from rice, most preferably a GOS2 sequence as represented by SEQ ID NO: 295.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter, whether natural or synthetic, may be used to drive expression of the nucleic acid sequence, but preferably the promoter is of plant origin. A constitutive promoter is particularly useful in the methods. Preferably the constitutive promoter is also a ubiquitous promoter of medium strength. See the "Definitions" section herein for definitions of the various promoter types.

Concerning DUS1L polypeptides, advantageously, any type of promoter, whether natural or synthetic, may be used to increase expression of the nucleic acid sequence. A constitutive promoter is particularly useful in the methods, preferably a constitutive promoter isolated from a plant genome. The plant constitutive promoter drives expression of a coding sequence at a level that is in all instances below that obtained under the control of a 35S CaMV viral promoter. An example of such a promoter is a GOS2 promoter as represented by SEQ ID NO: 295.

Concerning DUS1L polypeptides, organ-specific promoters, for example for preferred expression in leaves, stems, tubers, meristems, seeds, are useful in performing the methods of the invention. Developmentally-regulated and inducible promoters are also useful in performing the methods of the invention. See the "Definitions" section herein for definitions of the various promoter types.

Concerning BET1-like polypeptides, it should be clear that the applicability of the present invention is not restricted to the BET1-like polypeptide-encoding nucleic acid represented by SEQ ID NO: 1, nor is the applicability of the invention restricted to expression of a BET1-like polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 103, most preferably the constitutive promoter is as represented by SEQ ID NO: 103. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 103, and the nucleic acid encoding the BET1-like polypeptide.

Concerning Calreticulin polypeptides, it should be clear that the applicability of the present invention is not restricted to the Calreticulin polypeptide-encoding nucleic acid represented by SEQ ID NO: 104, nor is the applicability of the invention restricted to expression of a Calreticulin polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 257, most preferably the constitutive promoter is as represented by SEQ ID NO: 257. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 257, and the nucleic acid encoding the Calreticulin polypeptide.

Concerning DUS1L polypeptides, it should be clear that the applicability of the present invention is not restricted to a nucleic acid sequence encoding the DUS1L polypeptide, as represented by SEQ ID NO: 258, nor is the applicability of the invention restricted to expression of a DUS1L polypeptide-encoding nucleic acid sequence when driven by a constitituve promoter.

Optionally, one or more terminator sequences may be used in the construct introduced into a plant.

Concerning ES43-like polypeptides, it should be clear that the applicability of the present invention is not restricted to the ES43-like polypeptide-encoding nucleic acid represented by SEQ ID NO: 298, nor is the applicability of the invention restricted to expression of an ES43-like polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 386, most preferably the constitutive promoter is as represented by SEQ ID NO: 386. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 386, and the nucleic acid encoding the ES43-like polypeptide.

Concerning HON5-like polypeptides, it should be clear that the applicability of the present invention is not restricted to the HON5-like polypeptide-encoding nucleic acid represented by SEQ ID NO: 387, nor is the applicability of the invention restricted to expression of a HON5-like polypeptide-encoding nucleic acid when driven by a constitutive promoter, or when driven by a root-specific promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 416, most preferably the constitutive promoter is as represented by SEQ ID NO: 416. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 416, and the nucleic acid encoding the HON5-like polypeptide.

Concerning GSA1 polypeptides, it should be clear that the applicability of the present invention is not restricted to the GSA1 polypeptide-encoding nucleic acid represented by SEQ ID NO: 417, nor is the applicability of the invention restricted to expression of a GSA1 polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 492, most preferably the constitutive promoter is as represented by SEQ ID NO: 492. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 492, and the nucleic acid encoding the GSA1 polypeptide.

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

It is known that upon stable or transient integration of nucleic acid sequences into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid sequence molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid sequence can be identified for example by selection (for example, cells which have integrated the selectable marker survive whereas the other cells die). The marker genes may be removed or excised from the transgenic cell once they are no longer needed. Techniques for marker gene removal are known in the art, useful techniques are described above in the definitions section.

The invention also provides a method for the production of transgenic plants having enhanced yield-related traits relative to control plants, comprising introduction and expression in a plant of any nucleic acid encoding a BET1-like polypeptide, or a Calreticulin polypeptide, or a DUS1L polypeptide, or an ES43-like polypeptide, or a HON5-like polypeptide, or a GSA1 polypeptide, as defined hereinabove.

More specifically, the present invention provides a method for the production of transgenic plants having enhanced yield-related traits, particularly increased (seed) yield, which method comprises:

(i) introducing and expressing in a plant or plant cell a nucleic acid encoding a BET1-like polypeptide, or a Calreticulin polypeptide, or a DUS1L polypeptide, or an ES43-like polypeptide, or a HON5-like polypeptide, or a GSA1 polypeptide; and (ii) cultivating the plant cell under conditions promoting plant growth and development.

The nucleic acid of (i) may be any of the nucleic acids capable of encoding a BET1-like polypeptide, or a Calreticulin polypeptide, or a DUS1L polypeptide, or an ES43-like polypeptide, or a HON5-like polypeptide, or a GSA1 polypeptide, as defined herein.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the above-mentioned publications by S. D. Kung and R. Wu, Potrykus or Hofgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding a BET1-like polypeptide, or a Calreticulin polypeptide, or a DUS1L polypeptide, or an ES43-like polypeptide, or a HON5-like polypeptide, or a GSA1 polypeptide, as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, linseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, triticale, *sorghum*, emmer, spelt, *secale*, einkorn, teff, milo and oats.

The invention also extends to harvestable parts of a plant such as, but not limited to seeds, leaves, fruits, flowers, stems, roots, rhizomes, tubers and bulbs, which harvestable parts comprise a recombinant nucleic acid encoding a BET1-like polypeptide, or a Calreticulin polypeptide, or a DUS1L polypeptide, or an ES43-like polypeptide, or a HON5-like polypeptide, or a GSA1 polypeptide. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Methods for increasing expression of nucleic acids or genes, or gene products, are well documented in the art and examples are provided in the definitions section.

As mentioned above, a preferred method for modulating expression of a nucleic acid encoding a BET1-like polypeptide, or a Calreticulin polypeptide, or a DUS1L polypeptide, or an ES43-like polypeptide, or a HON5-like polypeptide, or a GSA1 polypeptide, is by introducing and expressing in a plant a nucleic acid encoding a BET1-like polypeptide, or a Calreticulin polypeptide, or a DUS1L polypeptide, or an ES43-like polypeptide, or a HON5-like polypeptide, or a GSA1 polypeptide; however the effects of performing the method, i.e. enhancing yield-related traits may also be achieved using other well known techniques, including but not limited to T-DNA activation tagging, TILLING, homologous recombination. A description of these techniques is provided in the definitions section.

The present invention also encompasses use of nucleic acids encoding BET1-like polypeptides, or Calreticulin polypeptides, or ES43-like polypeptides, or HON5-like polypeptides, or GSA1 polypeptides, as described herein and use of these BET1-like polypeptides, or Calreticulin polypeptides, or ES43-like polypeptides, or HON5-like polypeptides, or GSA1 polypeptides, in enhancing any of the aforementioned yield-related traits in plants.

The present invention also encompasses use of nucleic acid sequences encoding DUS1L polypeptides as described herein and use of these DUS1L polypeptides in increasing any of the aforementioned yield-related traits in plants, under normal growth conditions, under abiotic stress growth (preferably osmotic stress growth conditions) conditions, and under growth conditions of reduced nutrient availability, preferably under conditions of reduced nitrogen availability.

Nucleic acids encoding BET1-like polypeptide, or Calreticulin polypeptide, or DUS1L polypeptide, or ES43-like polypeptide, or HON5-like polypeptide, or GSA1 polypeptide, described herein, or the BET1-like polypeptides, or Calreticulin polypeptides, or DUS1L polypeptides, or ES43-like polypeptides, or HON5-like polypeptides, or GSA1 polypeptides, themselves, may find use in breeding programmes in which a DNA marker is identified which may be genetically linked to a BET1-like polypeptide-encoding gene. The nucleic acids/genes, or the BET1-like polypeptides, or Calreticulin polypeptides, or DUS1L polypeptides, or ES43-like polypeptides, or HON5-like polypeptides, or GSA1 polypeptides, themselves may be used to define a molecular marker. This DNA or protein marker may then be used in breeding programmes to select plants having enhanced yield-related traits as defined hereinabove in the methods of the invention.

Allelic variants of a nucleic acid/gene encoding a BET1-like polypeptide, or a Calreticulin polypeptide, or a DUS1L polypeptide, or an ES43-like polypeptide, or a HON5-like polypeptide, or a GSA1 polypeptide, may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding BET1-like polypeptides, or Calreticulin polypeptides, or DUS1L polypeptides, or ES43-like polypeptides, or HON5-like polypeptides, or GSA1 polypeptides, may also be used as probes for genetically and physically mapping the genes that they are a part of, and as markers for traits linked to those genes. Such information may be useful in plant breeding in order to develop lines with desired phenotypes. Such use of nucleic acids encoding BET1-like polypeptides, or Calreticulin polypeptides, or DUS1L polypeptides, or ES43-like polypeptides, or HON5-like polypeptides, or GSA1 polypeptides, requires only a nucleic acid sequence of at least 15 nucleotides in length. The nucleic acids encoding BET1-like polypeptides, or Calreticulin polypeptides, or DUS1L polypeptides, or ES43-like polypeptides, or HON5-like polypeptides, or GSA1 polypeptides, may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the POI-encoding nucleic acids. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid encoding BET1-like polypeptides, or Calreticulin polypeptides, or DUS1L polypeptides, or ES43-like polypeptides, or HON5-like polypeptides, or GSA1 polypeptides, in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanced yield-related traits, as described hereinbefore. These traits may also be combined with other economically advantageous traits, such as further yield-enhancing traits, tolerance to abiotic and biotic stresses, tolerance to herbicides, insecticides, traits modifying various architectural features and/or biochemical and/or physiological features.

Description of Figures

The present invention will now be described with reference to the following figures in which:

FIG. 2 represents a multiple alignment of BET1-like polypeptides. Sequences shown are: A.arenosa_x_thaliana_TA52_378006_1 (SEQ ID NO: 4); B.napus_BN06MS42331943.f_k04_1_40488_1 (SEQ ID NO: 12); *V.corymbosum*_CV091429_1 (SEQ ID NO: 80); *V.corymbosum*_TA638_69266_1 (SEQ ID NO:82); *B.vulgaris*_DV501764_1 (SEQ ID NO: 18); *B.pendula*_CD278481_1 (SEQ ID NO: 16); *C.reticulata*_x_temple_DN795225_1 (SEQ ID NO: 20); *P.dulcis*_TA313_3755_1 (SEQ ID NO: 50); *V.riparia*_TA839_96939_1 (SEQ ID NO: 84 ); *L.serriola*_TA5233_75943_1 (SEQ ID NO: 30); *S.indicum*_TA1114_4182_1(SEQ ID NO: 78); *G.biloba*_DR064764_1(SEQ ID NO: 26); *P.abies*_TA1522_3329_1 (SEQ ID NO: 36); *P.sitchensis*_TA10405_3332_1 (SEQ ID NO: 66); *P.abies*_TA1523_3329_1 (SEQ ID NO: 38); *P.engelmannii*_x_glauca_CO203682_1(SEQ ID NO: 52); *P.pinaster*_BX678743_1 (SEQ ID NO: 56); *P.taeda*_TA16676_3352_1(SEQ ID NO: 70); *P.pinaster*_TA4882_71647_1 (SEQ ID NO: 64); *P.taeda*_TA3629_3352_1 (SEQ ID NO: 74); *P.abies*_TA2417_3329_1 (SEQ ID NO: 40); *P.menziesii*_TA1952_3357_1 (SEQ ID NO: 54); *P.pinaster*_BX682074_1 (SEQ ID NO: 58); *P.taeda*_TA22888_3352_1 (SEQ ID NO: 72); *P.pinaster*_CR392675_1 (SEQ ID NO: 60); *P.pinaster*_TA4836_71647_1 (SEQ ID NO: 62); *P.taeda*_CO162523_1 (SEQ ID NO: 68); *P.taeda*_TA4949_3352_1 (SEQ ID NO: 76); T----M---_25296 (SEQ ID NO: 2); *Z.mays*_DR787277_1 (SEQ ID NO: 92); *Z.mays*_ZM07MC13625_57676372_13595_1 (SEQ ID NO: 96); *Z.mays*_c62091609gm030403_7698_1 (SEQ ID NO: 88); mays_DQ245377_1 (SEQ ID NO: 90); *Z.mays*_EC364520_1 (SEQ ID NO: 94); *Z.mays*_c57759235gm030403_14494_1 (SEQ ID NO: 86); *A.majus*_AJ789814_1 (SEQ ID NO: 8); *P.coccineus*_TA3810_3886_1 (SEQ ID NO: 48); *C.tetragonoloba*_EG981304_1 (SEQ ID NO: 22); *M.truncatula*_AC169182_23.5_1 (SEQ ID NO: 32; ); *G.max*_TA67390_3847_1 (SEQ ID NO: 28); *C.tetragonoloba*_EG987480_1 (SEQ ID NO: 24); *M.truncatula*_AC16918239.5_1 (SEQ ID NO: 34); *A.hypogaea*_EE124570_1 (SEQ ID NO: 6); *P.coccineus*_CA908259_1 (SEQ ID NO: 42); *P.coccineus*_CA908272_1 (SEQ ID NO: 44); *P.coccineus*_TA26993886_1 (SEQ ID NO: 46); *A.thaliana*_AT1G56233.1_1 (SEQ ID NO: 10); and *B.napus*_CD815839_1 (SEQ ID NO: 14).

FIG. 4 represents a multiple alignment of Calreticulin polypeptides. Structural characteristic elements of Calreticulin polypeptides are indicated over the consensus sequence. Sequences shown are: *A.formosa*_TA8804 (SEQ ID NO: 195); *C.maculosa*_TA223 (SEQ ID NO: 201); *P.trifoliata*_TA7309 (SEQ ID NO: 221); *E.esula*_TA10075 (SEQ ID NO: 203); *M.domestica*_TA28184 (SEQ ID NO: 209); *M.truncatula*_TA23636 (SEQ ID NO: 211); *V.vinifera*_GSVIVT00025039001 (SEQ ID NO: 227); *A.thaliana*_AT1G08450_CRT3 (SEQ ID NO: 197); *B.napus*_BPS_33882 (SEQ ID NO: 199); *G.raimondii*_TA11257 (SEQ ID NO:205) *P.trichocarpa*_VII.148 (SEQ ID NO: 219); *H.vulgare*_TA32081 (SEQ ID NO: 207); *T.aestivum*_TA53764 (SEQ ID NO: 225); *O.sativa*_Os01g67054.1 (SEQ ID NO: 213); *Z.mays*_TA15627 (SEQ ID NO: 231); *O.sativa*_Os05g43170.1 (SEQ ID NO: 215); *S.bicolor*_TA24664 (SEQ ID NO: 223); *Z.mays*_BPS_22383 (SEQ ID NO: 229); *P.patens*_164102 (SEQ ID NO: 217); *C.reinhardtii*_TA11983 (SEQ ID NO: 233); *P.pinaster*_TA4383 (SEQ ID NO: 163); *P.taeda*_TA5639 (SEQ ID NO: 167); *W.mirabilis*_TA538 (SEQ ID NO: 191); *P.sitchensis*_TA20930 (SEQ ID NO: 165); *B.distachyon*_TA448 (SEQ ID NO: 115); *O.sativa*_Os03g0832200 (SEQ ID NO: 157); *H.vulgare*_TA38555 (SEQ ID NO: 143); *T.aestivum*_TA74192 (SEQ ID NO: 187); *S.bicolor*_TA25211 (SEQ ID NO: 179); *H.vulgare*_BPS_7785(SEQ ID NO: 141); *T.aestivum*_TA50840 (SEQ ID NO: 185); *S.bicolor*_TA20922 (SEQ ID NO: 177); *Z.mays*_TA170881 (SEQ ID NO: 193); *O.sativa*_Os07g0246200 (SEQ ID NO:159); *A.trichopoda*_TA1102 (SEQ ID NO: 113); *A.thaliana*_AT1G09210_CRT2 (SEQ ID NO:109); *B.napus*_BPS_28478 (SEQ ID NO: 117); *A.thaliana*_AT1G56340_CRT1 (SEQ ID NO: 111); *B.napus*_TA20659 (SEQ ID NO: 119); *A.formosa*_TA9419 (SEQ ID NO: 107); *C.annuum*_TA4292 (SEQ ID NO: 123); *S.habrochaites*_TA1435 (SEQ ID NO: 181); *S.lycopersicum*_TA36564 (SEQ ID NO: 105); *S.tuberosum*_TA24720 (SEQ ID NO: 183); *G.hirsutum*_TA20990 (SEQ ID NO: 129); *G.raimondii*_TA8857 (SEQ ID NO: 133); *G.raimondii*_TA8860 (SEQ ID NO: 135); *I.nil*_TA5002 (SEQ ID NO: 145); *C.endivia*_TA1106 (SEQ ID NO: 125); *C.solstitialis*_TA9 (SEQ ID NO: 127); *H.annuus*_TA7525 (SEQ ID No: 137); *H.argophyllus*_TA1300 (SEQ ID NO: 139); *L.serriola*_TA711 (SEQ ID NO: 149); *O.basilicum*_TA646 (SEQ ID NO: 155); *B.vulgaris*_TA7257 (SEQ ID NO: 121); *M.domestica*_TA24948 (SEQ ID NO: 151); *P.persica*_TA3474 (SEQ ID NO: 161); *G.max*_BPS_38275 (SEQ ID NO: 131); *P.vulgaris*_TA3122 (SEQ ID NO: 173); *L.japonicus*_TA548 (SEQ ID NO: 147); *M.truncatula*_AC149474 (SEQ ID NO: 153); *P.trichocarpa*_133.107 (SEQ ID NO: 169); *P.trichocarpa*_729432 (SEQ ID NO: 171); *R.communis*_U74630 (SEQ ID NO: 175); and *V.vinifera*_TA38405 (SEQ ID NO: 189).

FIG. 9 shows an AlignX (from Vector NTI 10.3, Invitrogen Corporation) multiple sequence alignment of the DUS1L polypeptides from Table A3. One important domain is a tRNA-dihydrouridine synthase domain with an InterPro entry IPR001269 (integrating the PFAM PF01207 entry (marked by X's). One important motif is the tRNA-dihydrouridine synthase conserved site with an InterPro entry IPR018517 (integrating the PROSITE PSO1136 (marked by X's, in bold in SEQ ID NO: Sacof_DUS1L). Conserved residues are heavily boxed, in particular a Cys residue which is in other organisms a key general-acid/base catalyst. Sequences shown are: *A.thaliana*_AT5G67220.1 (SEQ ID NO: 261); *B.napus*_BN06MC20455 (SEQ ID NO: 265); *B.napus*_TC79818 (SEQ ID NO: 263); *P.patens*_149014 (SEQ ID NO: 277); *S.moellendorffii*_443602 (SEQ ID NO: 283); *P.taeda*_TA13257_3352 (SEQ ID NO: 279); *O.sativa*_LOC_Os06g49870.1 (SEQ ID NO: 275); Sacof_DuS1L (SEQ ID NO: 259); *S.bicolor*_Sb10g029830.1 (SEQ ID NO: 287); *Z.mays*_ZM07MC04636 (SEQ ID NO:

293); G.max_Glyma05g20510.1 (SEQ ID NO: 273); G.max_Glyma17g18490.1 (SEQ ID NO: 271); R.communis_TA2745_3988 (SEQ ID NO: 281); S.lycopersicum_TC206234 (SEQ ID NO: 285); V.vinifera_GS-VIVT0001954 (SEQ ID NO: 289); C.vulgaris_36290 (SEQ ID NO: 267); V.carteri_80128 (SEQ ID NO: 291); and E.huxleyi_437158 (SEQ ID NO: 269).

Figure 10:
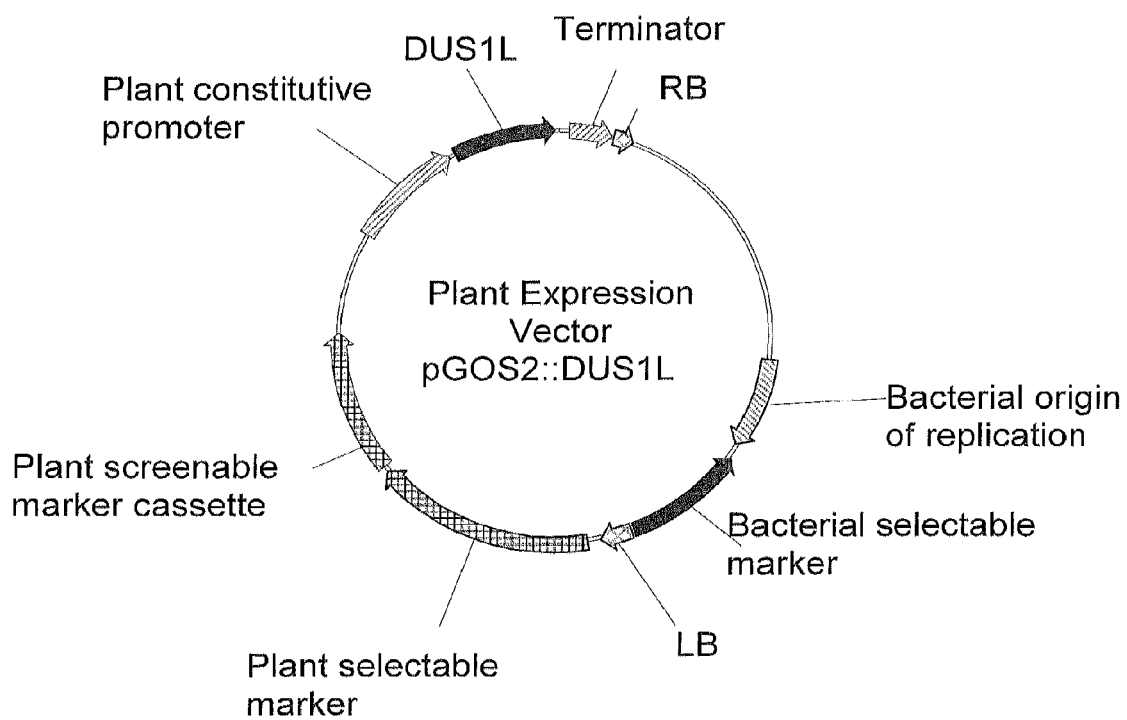

FIG. 10 shows the binary vector for increased expression in Oryza sativa plants of a nucleic acid sequence encoding a DUS1L polypeptide under the control of a promoter functioning in plants.

FIG. 11 represents the amino acid sequence of the ES43-like polypeptide represented SEQ ID NO: 299 with the BAH domain in bold and the PHD domain underlined.

FIG. 12 represents a multiple alignment of ES43-like polypeptides. Sequences shown are: O.sativa_Os07g0186400#1 (SEQ ID NO: 325); T_M_---_29382_---4312_116 (SEQ ID NO: 299); O.sativa_AK061201#1 (SEQ ID NO: 327); Z.mays_TA12947_4577999#1 (SEQ ID NO: 369); Z.mays_ZM07MC24083_BFb0146O24@(SEQ ID NO: 293); H.vulgare_TA40508_4513#1 (SEQ ID NO: 317); H.vulgare_TA35269_4513#1 (SEQ ID NO: 311); O.sativa_Os03g0799600#1 (SEQ ID NO: 329); A.thaliana_AT4G39100.1#1 (SEQ ID NO: 305); T_M_---_2176_---0490_46_8 (SEQ ID NO: 357); B.napus_BN06MC06825_42494234@6 (SEQ ID NO: 309); P.trichocarpa_scaff_IV.1226#1 (SEQ ID NO: 341); S.lycopersicum_TA42220_4081#1 (SEQ ID NO: 353); A.thaliana_AT4G22140.1#1 (SEQ ID NO: 301); A.thaliana_AT4G22140.2#1 (SEQ ID NO: 303); A.thaliana_AT4G04260.1#1 (SEQ ID NO: 307); P.trichocarpa_scaff_XI.104#1 (SEQ ID NO: 345); .trichocarpa_scaff_166.34#1 (SEQ ID NO: 349); H.vulgare_TA42493_4513#1 (SEQ ID NO: 313); T.aestivum_c54968390@13747#1 (SEQ ID NO: 365); T_M_---_14367_---4367_137 (SEQ ID NO: 359); T.aestivum_TA54637_4565#1 (SEQ ID NO: 361); H.vulgare_BF623189#1 (SEQ ID NO: 315); O.sativa_Os09g0386500#1 (SEQ ID NO: 321); Z.mays_TA19459_4577999#1 (SEQ ID NO: 367); Z.mays_ZMO7MC24174_BFb0045F09@(SEQ ID NO: 373); O.sativa_Os08g0421900#1 (SEQ ID NO: 323); P.trichocarpa_scaff_II.2065#1 (SEQ ID NO: 351); S.lycopersicum_TA40478_4081#1 (SEQ ID NO: 355); P.trichocarpa_scaff_XIV.1045#1 (SEQ ID NO: 343); P.trichocarpa_scaff 1247.1#1 (SEQ ID NO: 347); P.patens_149469#1 (SEQ ID NO: 333); P.patens_108696#1 (SEQ ID NO: 335); P.patens_153027#1 (SEQ ID NO: 331); P.patens_59496#1 (SEQ ID NO: 337); P.patens_213413#1 (SEQ ID NO: 339); T.aestivum_CK201479#1 (SEQ ID NO: 363); and L.usitatissimum_LUO4MC11049_62 (SEQ ID NO: 319).

Figure 13:
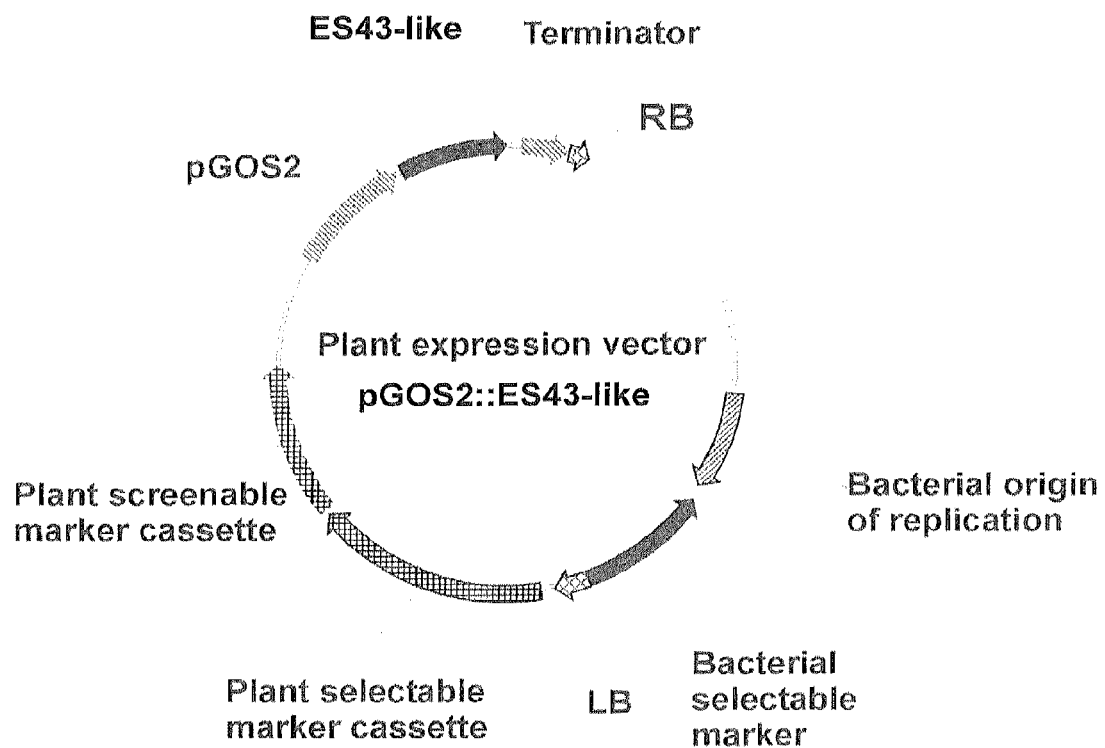

FIG. 13 represents the binary vector used for increased expression in Oryza sativa of a ES43-like-encoding nucleic acid under the control of a rice GOS2 promoter (pGOS2).

FIG. 14 represents a multiple alignment of HON5-like polypeptides. HI/H5 domain is indicated between brackets and AThook domains are indicated by rectangles. Sequences shown are; Arath_HMGA2 (SEQ ID NO: 390); Arath_Hon4 (SEQ ID NO: 392); Brana_Hon5 like (SEQ ID NO: 394); Glyma_HON5 like (SEQ ID NO: 396); Lotja_HMGA1701 (SEQ ID NO: 402); Poptr_HMGA905 (SEQ ID NO: 388); Poptr_HMGA906 (SEQ ID NO: 406); Vitvi_hon5 like (SEQ ID NO: 409); Gosar_HMGA10101 (SEQ ID NO: 398); Gosar_HMGA14201 (SEQ ID NO: 400); Orysa_HMGA2201 (SEQ ID NO: 404); and Sacof_HMGA2503 (SEQ ID NO: 408).

Figure 15:
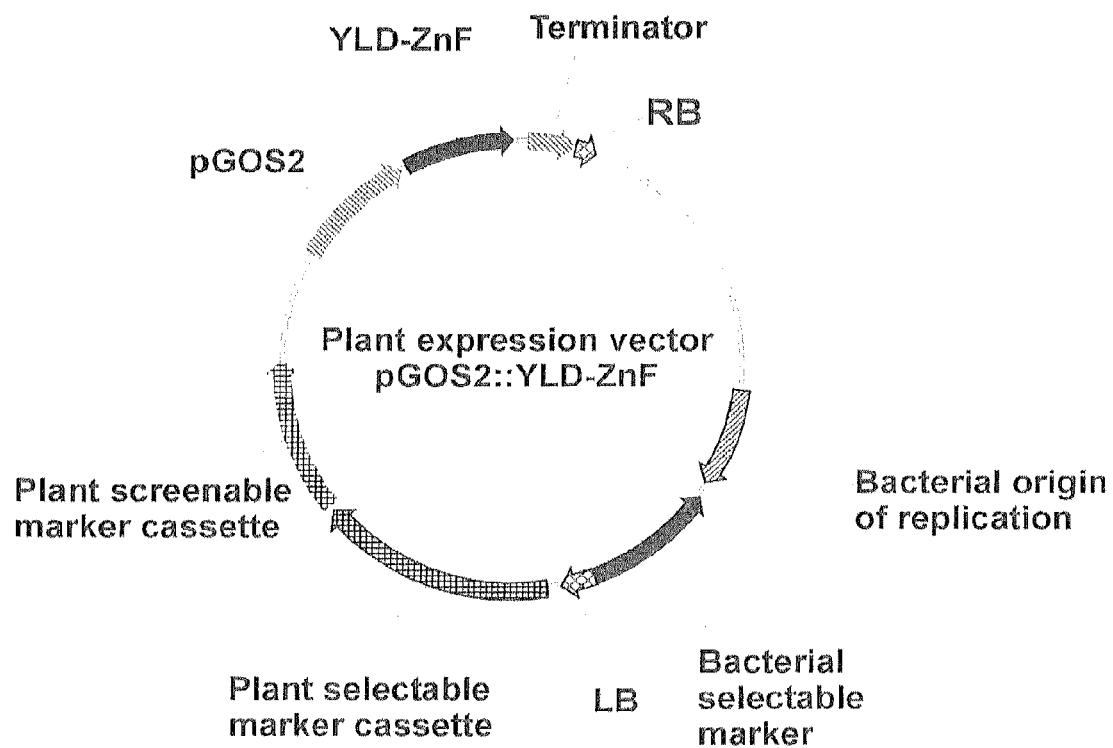

FIG. 15 represents the binary vector used for increased expression in Oryza sativa of a HON5-like-encoding nucleic acid represented by SEQ ID NO: 387 under the control of a rice GOS2 promoter (pGOS2)

Figure 16:
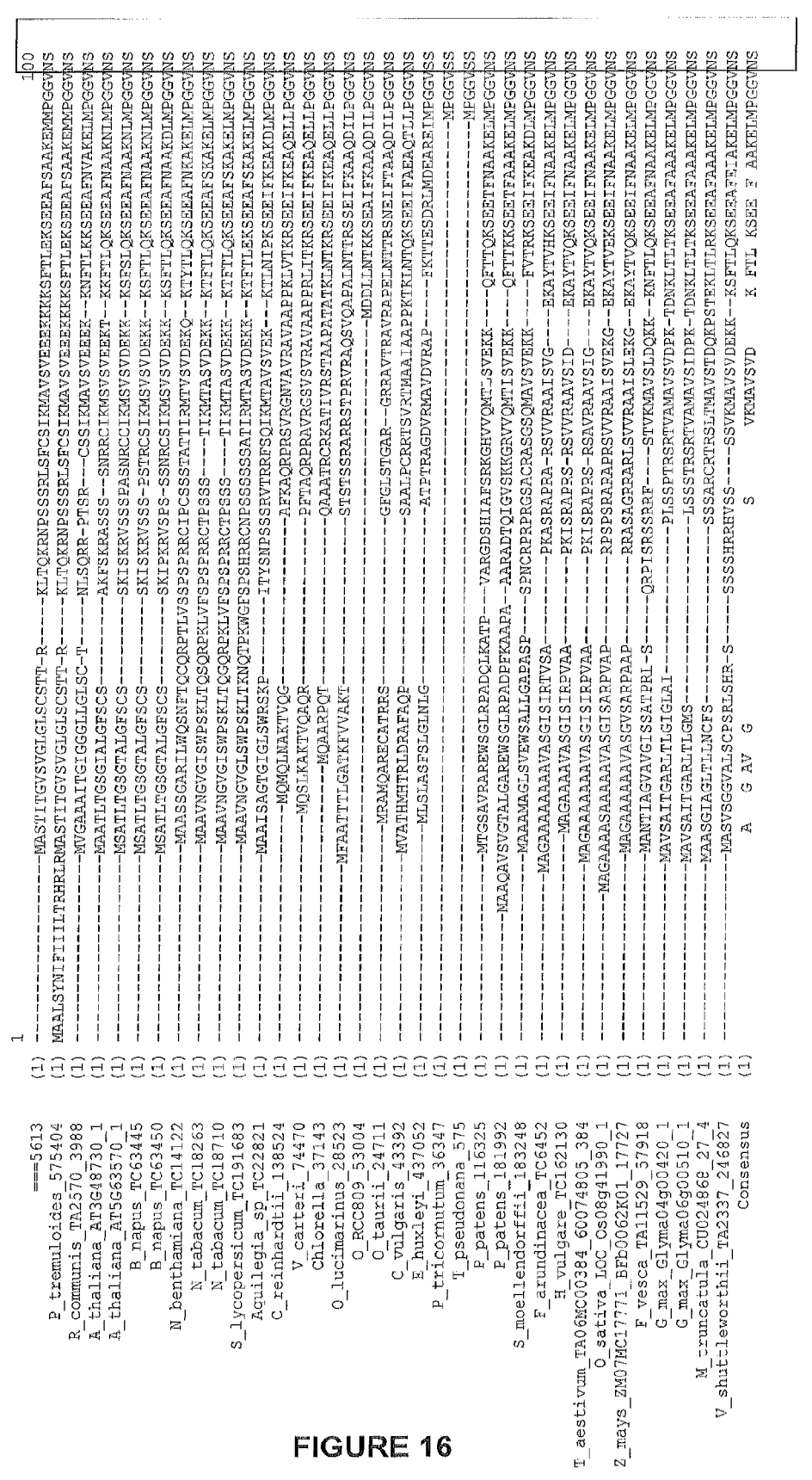
Figure 16:
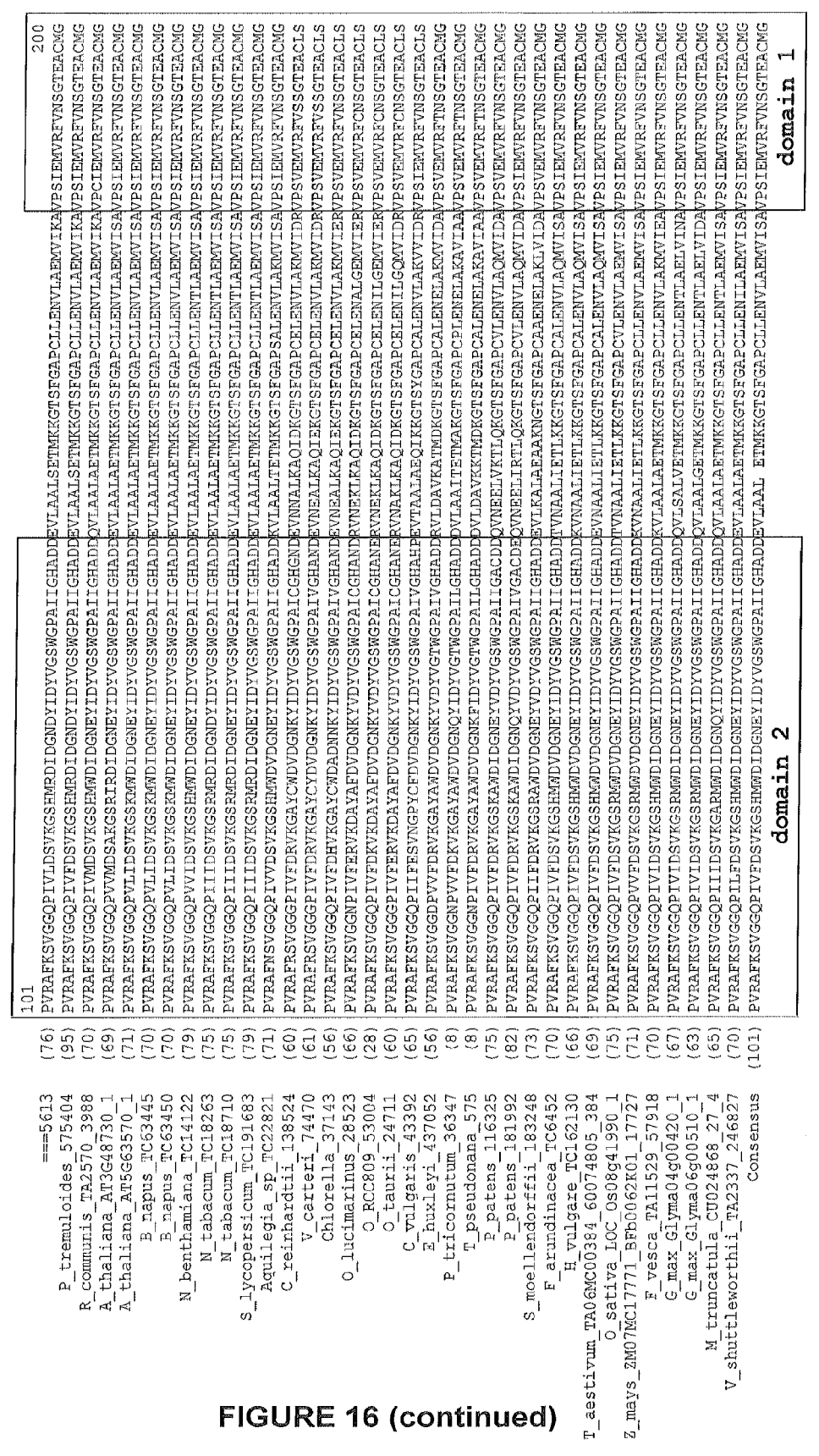
Figure 16:
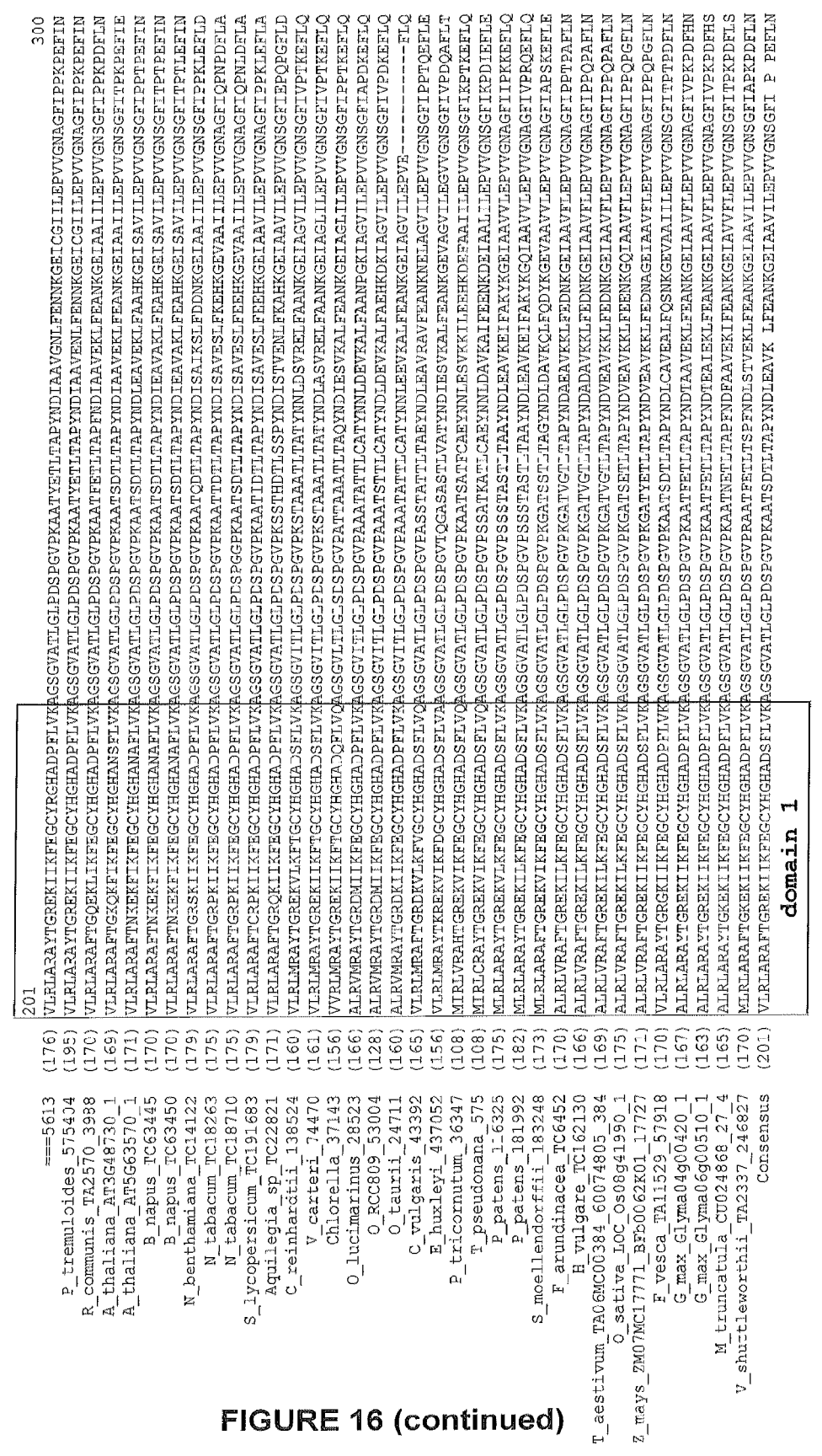
Figure 16:
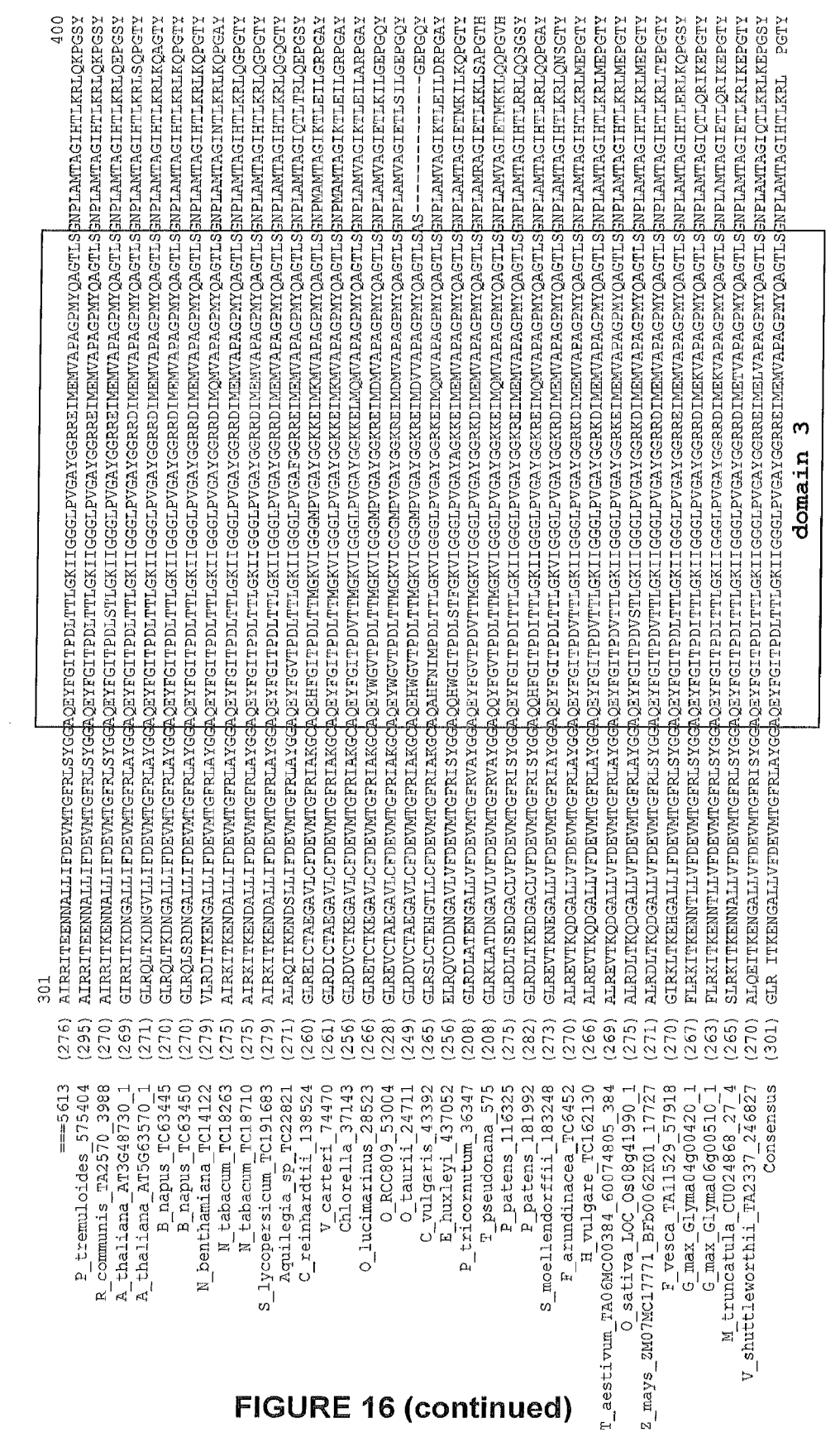
Figure 16:
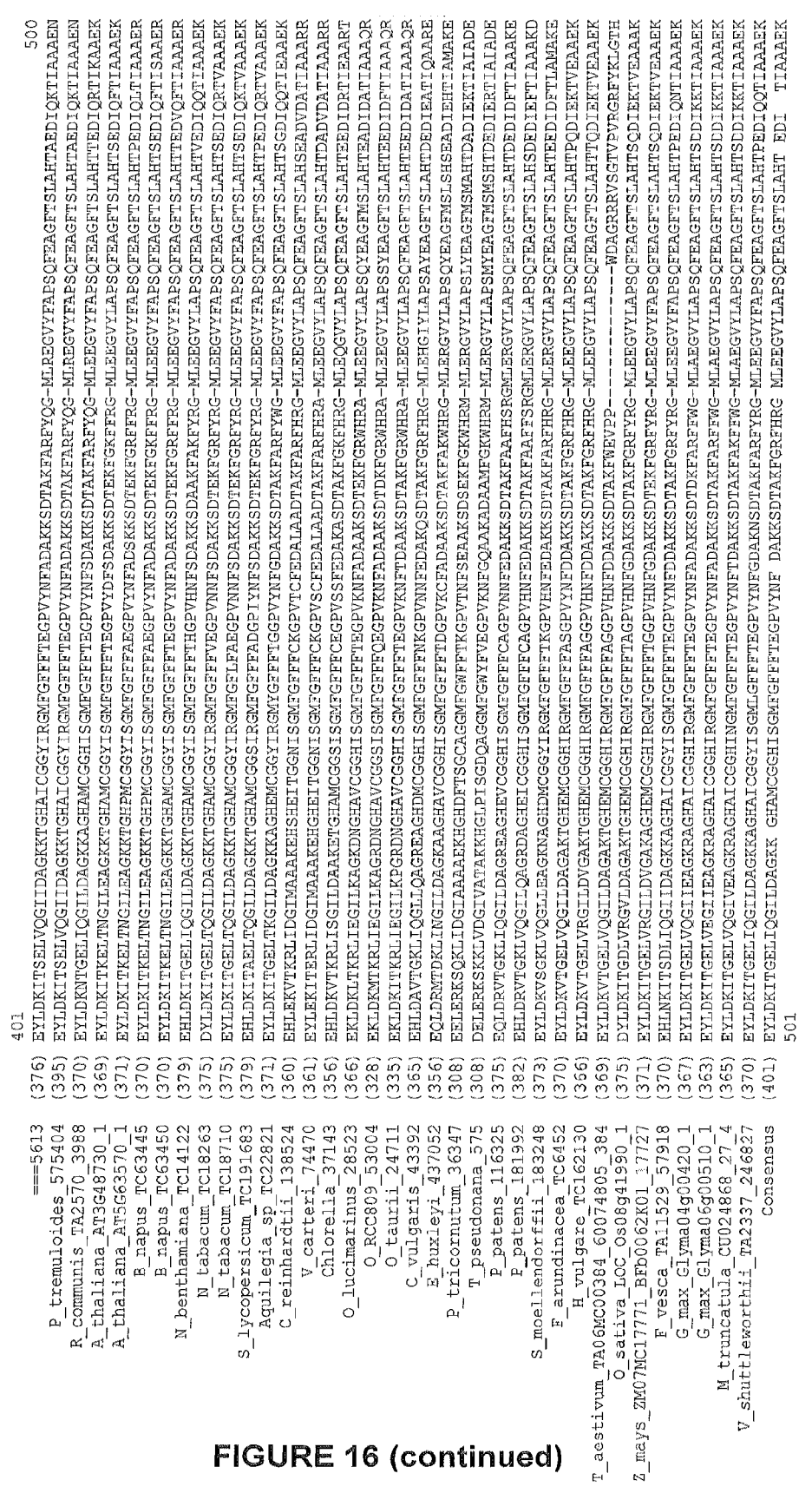

FIG. 16 represents a multiple alignment of GSA1-like sequences. Sequences shown are: ===5613 (SEQ ID NO: 418); P_tremuloides_575404 (SEQ ID NO: 468); R_communis_TA2570_3988 (SEQ ID NO: 472); A_thaliana_AT3G48730_1 (SEQ ID NO: 420); A_thaliana_AT5G63570_1 (SEQ ID NO: 422); B_napus_TC63445 (SEQ ID NO: 426); B_napus_TC63450 (SEQ ID NO: 428); N_benthamiana_TC14122 (SEQ ID NO: 450); N_tabacum_TC18263 (SEQ ID NO: 452); N_tabacum_TC18710 (SEQ ID NO: 454); S_lycopersicum_TC191683 (SEQ ID NO: 474); Aquilegia_sp_TC22821 (SEQ ID NO: 424); C_reinhardtii_138524 (SEQ ID NO: 430); V_carteri_74470 (SEQ ID NO: 482); Chlorella_37143 (SEQ ID NO: 434); O_lucimarinus_28523 (SEQ ID NO: 456); _RCC809_53004 (SEQ ID NO: 458); O_taurii_24711 (SEQ ID NO: 462); C_vulgaris_43392 (SEQ ID NO: 432); E_huxleyi_437052 (SEQ ID NO: 436); P_tricornutum_36347 (SEQ ID NO: 470); Tpseudonana_575 (SEQ ID NO: 480); P_patens_116325 (SEQ ID NO: 464); P_patens_181992 (SEQ ID NO: 466); S_moellendorffii_183248 (SEQ ID NO: 476); F_arundinacea_TC6452 (SEQ ID NO: 438); H_vulgare_TC162130 (SEQ ID NO: 446); T_aestivum_TA06MC00384_60074805_384 (SEQ ID NO: 478); O_sativa_LOC_Os08g41990_1 (SEQ ID NO: 460); Z_mays_ZM07MC17771_BFb0062K01_17727 (SEQ ID NO: 486); F_vesca_TA11529_57918 (SEQ ID NO: 440); G_max_Glyma04g00420_1 (SEQ ID NO: 442); G_max_Glyma06g00510_1 (SEQ ID NO: 444); M_truncatula_CU024868_27_4 (SEQ ID NO: 448); and V_shuttleworthii_TA2337_246827 (SEQ ID NO: 484).

Figure 17:
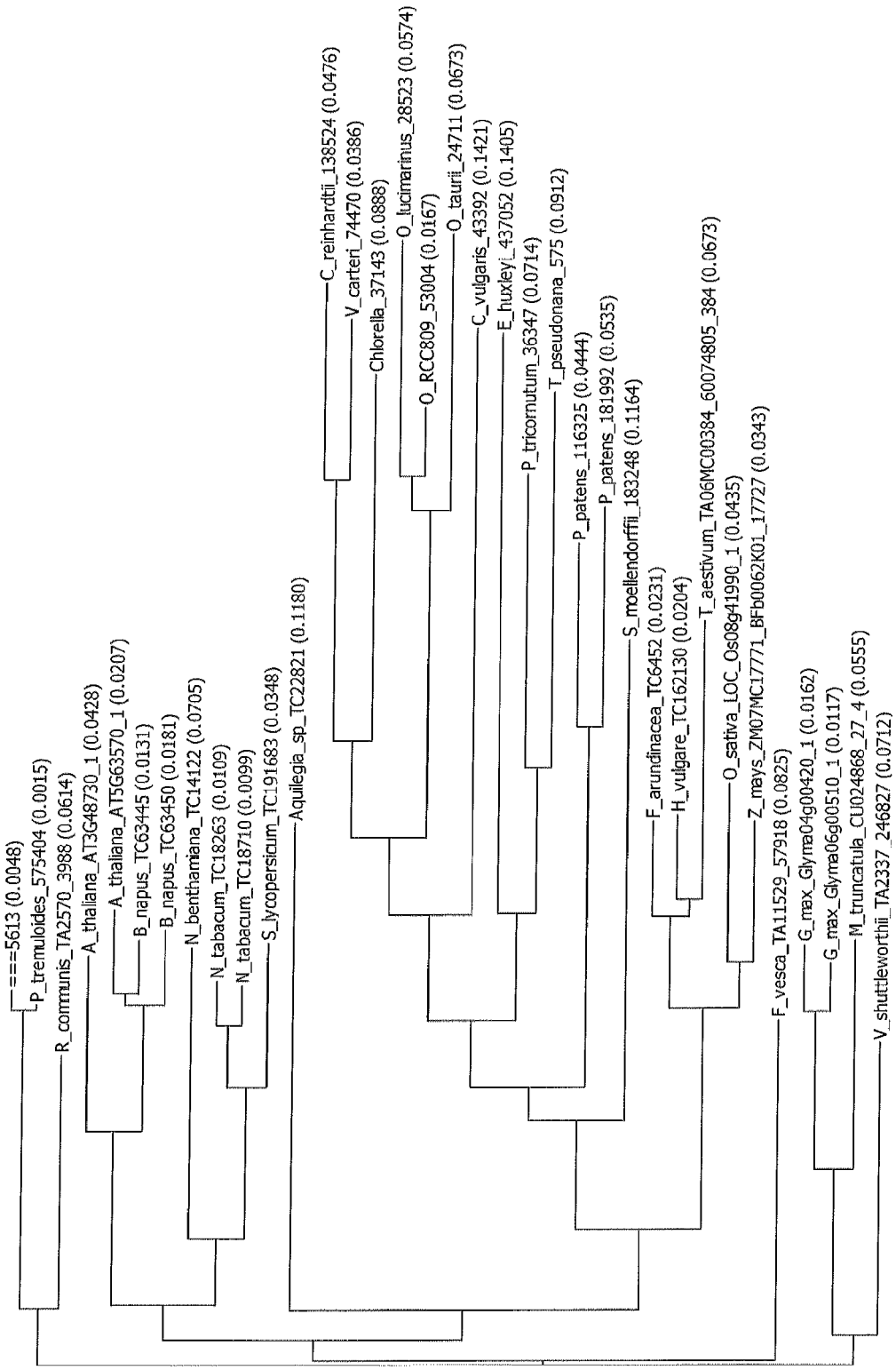

FIG. 17 shows a phylogenetic tree of GSA1-like sequences.

Figure 18:
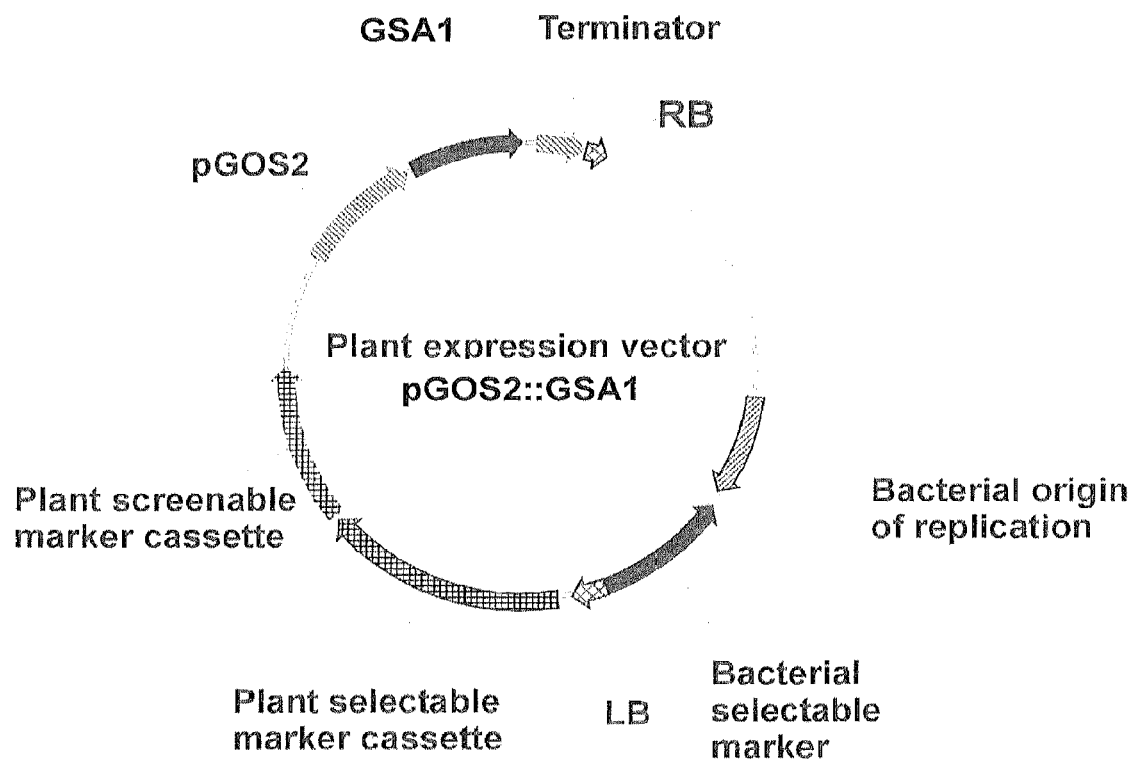

FIG. 18 represents the binary vector used for increased expression in Oryza sativa of a GSA1-encoding nucleic acid under the control of a rice GOS2 promoter (pGOS2).

Items

1. BET1-Like Polypeptides

1. A method for enhancing yield-related traits in plants relative to control plants, comprising modulating expression in a plant of a nucleic acid encoding BET1-like polypeptide, wherein said BET1-like polypeptide comprises a CC domain:
   (i) as represented by SEQ. ID NO: 97; and/or
   (ii) preferably having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the CC domain represented by SEQ ID NO: 98.

2. Method according to item 1, wherein the CC domain comprises one or more of the following motifs:

(i)   Motif 1: G(W/Y)CD(E/K);   (SEQ ID NO: 99)

(ii)  Motif 2: EGF,              (SEQ ID NO: 100)

3. Method according to item 1 or 2, wherein said modulated expression is effected by introducing and expressing in a plant a nucleic acid encoding a BET1-like polypeptide.

4. Method according to any one of items 1 to 3, wherein said nucleic acid encoding a BET1-like polypeptide encodes any one of the proteins listed in Table A1 or is a portion of such a nucleic acid, or a nucleic acid capable of hybridising with such a nucleic acid.
5. Method according to any one of items 1 to 4, wherein said nucleic acid sequence encodes an orthologue or paralogue of any of the proteins given in Table A1.
6. Method according to any preceding item, wherein said enhanced yield-related traits comprise increased yield, such as increased biomass and/or increased seed yield relative to control plants.
7. Method according to any one of items 1 to 6, wherein said enhanced yield-related traits are obtained under non-stress conditions.
8. Method according to any one of items 1 to 6, wherein said enhanced yield-related traits are obtained under conditions of drought stress and/or nitrogen deficiency.
9. Method according to any one of items 3 to 8, wherein said nucleic acid is operably linked to a constitutive promoter, preferably to a GOS2 promoter, most preferably to a GOS2 promoter from rice.
10. Method according to any one of items 1 to 9, wherein said nucleic acid encoding a BET1-like polypeptide is of plant origin, preferably from a dicotyledonous plant, further preferably from the family Poaceae, more preferably from the genus *Zea*, most preferably from *Zea mays*.
11. Plant or part thereof, including seeds, obtainable by a method according to any one of items 1 to 10, wherein said plant or part thereof comprises a recombinant nucleic acid encoding a BET1-like polypeptide.
12. Construct comprising:
    (a) nucleic acid encoding a BET1-like polypeptide as defined in items 1 or 2;
    (b) one or more control sequences capable of driving expression of the nucleic acid sequence of (a); and optionally
    (c) a transcription termination sequence.
13. Construct according to item 12, wherein one of said control sequences is a constitutive promoter, preferably a GOS2 promoter, most preferably a GOS2 promoter from rice.
14. Use of a construct according to item 12 or 13 in a method for making plants having increased yield, particularly increased biomass and/or increased seed yield relative to control plants.
15. Plant, plant part or plant cell transformed with a construct according to item 12 or 13.
16. Method for the production of a transgenic plant having increased yield, particularly increased biomass and/or increased seed yield relative to control plants, comprising:
    (i) introducing and expressing in a plant a nucleic acid encoding a BET1-like polypeptide as defined in item 1 or 2; and
    (ii) cultivating the plant cell under conditions promoting plant growth and development.
17. Transgenic plant having increased yield, particularly increased biomass and/or increased seed yield, relative to control plants, resulting from modulated expression of a nucleic acid encoding a BET1-like polypeptide as defined in item 1 or 2, or a transgenic plant cell derived from said transgenic plant.
18. Transgenic plant according to item 11, 15 or 17, or a transgenic plant cell derived thereof, wherein said plant is a crop plant such as sugarbeet, or a monocot or a cereal, such as rice, maize, wheat, sugarcane, barley, millet, rye, triticale, *sorghum* emmer, spelt, *secale*, einkorn, teff, milo and oats.
19. Harvestable parts of a plant according to item 18, wherein said harvestable parts are preferably shoot biomass and/or seeds.
20. Products derived from a plant according to item 18 and/or from harvestable parts of a plant according to item 19.
21. Use of a nucleic acid encoding a BET1-like polypeptide in increasing yield, particularly in increasing seed yield and/or shoot biomass in plants, relative to control plants.
22. An isolated nucleic acid molecule selected from:
    (i) a nucleic acid represented by any one of SEQ ID NO: 11 and 95;
    (ii) the complement of a nucleic acid represented by any one of SEQ ID NO: 11 and 95;
    (iii) a nucleic acid encoding the polypeptide as represented by any one of SEQ ID NO: 12 and 96 preferably as a result of the degeneracy of the genetic code, said isolated nucleic acid can be derived from a polypeptide sequence as represented by any one of SEQ ID NO: 12 and 96 and further preferably confers enhanced yield-related traits relative to control plants;
    (iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A1 and further preferably conferring enhanced yield-related traits relative to control plants;
    (v) a nucleic acid molecule which hybridizes with a nucleic acid molecule of (i) to (iv) under stringent hybridization conditions and preferably confers enhanced yield-related traits relative to control plants;
    (vi) a nucleic acid encoding a BET1-like polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 12 and 96 and any of the other amino acid sequences in Table A1 and preferably conferring enhanced yield-related traits relative to control plants.
23. An isolated polypeptide selected from:
    (i) an amino acid sequence represented by any one of SEQ ID NO: 12 and 96;
    (ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 12 and 96 and any of the other amino acid sequences in Table A1 and preferably conferring enhanced yield-related traits relative to control plants.
    (iii) derivatives of any of the amino acid sequences given in (i) or (ii) above.

2. Calreticulin Polypeptides
1. A method for enhancing yield-related traits in plants relative to control plants, comprising modulating expression in a plant of a nucleic acid encoding a Calreticulin polypeptide.
2. Method according to item 1, wherein said Calreticulin polypeptide comprises one or more of the following motifs:
   (i) Motif 3: PXXIXDPXXKKPEXWDD (SEQ ID NO: 246),
   (ii) Motif 4: GXWXXXXIXNPXYK (SEQ ID NO: 247),
   (iii) Motif 5: E[VL]WQVK (SEQ ID NO: 248),
   (iv) Motif 6: TLV[FL]QFSVKHEQKLDCGGGY[MV]KLLSGDVDQKKFGG[DE]TPYSI MFGPDICGY (SEQ ID NO: 249) which represents typical CRT plant polypeptides of the CRT1/2 group;
   (v) Motif 7: TPYS[LF]MFGPD[IL]CGTQTKKLH[VL]ILSYQGQNYPIKKDL[QE]CE TDKLTH[FV]YTFI (SEQ ID NO: 250) which represents typical CRT plant polypeptides of the CRT3 group;
   (vi) Motif 8: N[HY][LP]IKK[DE][VL]PCETD[QK]LTH[VF]YTFI[LI]RPDA[TS]YSILI DN[VR]E[KR][QE][TS]GS[LM]Y[TS]DWD[IL]L (SEQ ID NO: 251) which represents typical CRT polypeptides of the viridiplantae kingdom;
   (vii) Motif 9: QKKFGGDTPYSIMFGPDICGY[SQ]TKK[VL]H[AV]I (SEQ ID NO: 252), which represents typical CRT polypeptides of the eukaryotic origin,
   (viii) a motif having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to any one of the motifs (i) to (vii);
   Wherein "X" represents any amino acid and wherein amino acids indicated between brackets "[ ]" represent alternative amino acids at that location.
3. Method according to item 1 or 2, wherein said modulated expression is effected by introducing and expressing in a plant a nucleic acid encoding a Calreticulin polypeptide.
4. Method according to any one of items 1 to 3, wherein said nucleic acid encoding a Calreticulin polypeptide encodes any one of the proteins listed in Table A2 or is a portion of such a nucleic acid, or a nucleic acid capable of hybridising with such a nucleic acid.
5. Method according to any one of items 1 to 4, wherein said nucleic acid sequence encodes an orthologue or paralogue of any of the proteins given in Table A2.
6. Method according to any preceding item, wherein said enhanced yield-related traits comprise increased yield, increased seed yield relative to control plants.
7. Method according to any one of items 1 to 6, wherein said enhanced yield-related traits are obtained under non-stress conditions.
8. Method according to any one of items 1 to 6, wherein said enhanced yield-related traits are obtained under conditions of drought stress, salt stress or nitrogen deficiency.
9. Method according to any one of items 3 to 8, wherein said nucleic acid is operably linked to a constitutive promoter, preferably to a GOS2 promoter, most preferably to a GOS2 promoter from rice.
10. Method according to any one of items 1 to 9, wherein said nucleic acid encoding a Calreticulin polypeptide is of plant origin, preferably from a dicotyledonous plant, further preferably from the family Solanaceae, more preferably from the genus *Solanum*, most preferably from *Solanum lycopersicum*.
11. Plant or part thereof, including seeds, obtainable by a method according to any one of items 1 to 10, wherein said plant or part thereof comprises a recombinant nucleic acid encoding a Calreticulin polypeptide.
12. Construct comprising:
    (i) nucleic acid encoding a Calreticulin polypeptide as defined in items 1 or 2;
    (ii) one or more control sequences capable of driving expression of the nucleic acid sequence of (a); and optionally
    (iii) a transcription termination sequence.
13. Construct according to item 12, wherein one of said control sequences is a constitutive promoter, preferably a GOS2 promoter, most preferably a GOS2 promoter from rice.
14. Use of a construct according to item 12 or 13 in a method for making plants having increased yield, particularly increased seed yield relative to control plants.
15. Plant, plant part or plant cell transformed with a construct according to item 12 or 13.
16. Method for the production of a transgenic plant having increased yield, particularly increased seed yield relative to control plants, comprising:
    (i) introducing and expressing in a plant a nucleic acid encoding a Calreticulin polypeptide as defined in item 1 or 2; and
    (ii) cultivating the plant cell under conditions promoting plant growth and development.
17. Transgenic plant having increased yield, particularly increased seed yield, relative to control plants, resulting from modulated expression of a nucleic acid encoding a Calreticulin polypeptide as defined in item 1 or 2, or a transgenic plant cell derived from said transgenic plant.
18. Transgenic plant according to item 11, 15 or 17, or a transgenic plant cell derived thereof, wherein said plant is a crop plant such as sugarbeet, or a monocot or a cereal, such as rice, maize, wheat, sugarcane, barley, millet, rye, triticale, *sorghum* emmer, spelt, *secale*, einkorn, teff, milo and oats.
19. Harvestable parts of a plant according to item 18, wherein said harvestable parts are preferably shoot biomass and/or seeds.
20. Products derived from a plant according to item 18 and/or from harvestable parts of a plant according to item 19.
21. Use of a nucleic acid encoding a Calreticulin polypeptide in increasing yield, particularly in increasing seed yield and/or shoot biomass in plants, relative to control plants.
22. An isolated Calreticulin nucleic acid molecule selected from:
    (i) a nucleic acid represented by any one of SEQ ID NO: 116, 130, 140, 198 and 228;
    (ii) the complement of a nucleic acid represented by any one of SEQ ID NO: 116, 130, 140, 198 and 228;
    (iii) a nucleic acid encoding the polypeptide as represented by any one of SEQ ID NO: 117, 131, 141, 199 and 229 preferably as a result of the degeneracy of the genetic code, said isolated nucleic acid can be derived from a polypeptide sequence as represented by any one of SEQ ID NO: 117, 131, 141, 199 and 229 and further preferably confers enhanced yield-related traits relative to control plants;
    (iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A2 and further preferably conferring enhanced yield-related traits relative to control plants;
- (v) a nucleic acid molecule which hybridizes with a nucleic acid molecule of (i) to
- (iv) under stringent hybridization conditions and preferably confers enhanced yield-related traits relative to control plants;
- (vi) a nucleic acid encoding a Calreticulin polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 117, 131, 141, 199 and 229 and any of the other amino acid sequences in Table A2 and preferably conferring enhanced yield-related traits relative to control plants.

23. An isolated Calreticulin polypeptide selected from:
    - (i) an amino acid sequence represented by any one of SEQ ID NO: 117, 131, 141, 199 and 229;
    - (ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 117, 131, 141, 199 and 229 and any of the other amino acid sequences in Table A2 and preferably conferring enhanced yield-related traits relative to control plants.
    - (iii) derivatives of any of the amino acid sequences given in (i) or (ii) above.

3. tRNA Dihydrouridine Synthase 1-Like Polypeptides (DUS1L Polypeptides)

1. A method for increasing yield-related traits in plants relative to control plants, comprising increasing expression in a plant of a nucleic acid sequence encoding a tRNA dihydrouridine synthase 1-like (DUS1L) polypeptide, which DUS1L polypeptide comprises (i) a tRNA-dihydrouridine synthase domain with an InterPro entry IPR001269; (ii) an aldolase-type TIM barrel domain with an InterPro entry IPR013785; and (iii) a tRNA-dihydrouridine synthase conserved site with an InterPro entry IPR018517, and optionally selecting for plants having increased yield-related traits.
2. Method according to item 1, wherein said DUS1L polypeptide comprises (i) in increasing order of preference at least 50%, 55%, 60%, 65%, 70%, 75%, 80%, 85%, 90%, 95%, 98%, 99% or more amino acid sequence identity to a tRNA-dihydrouridine synthase domain as represented by SEQ ID NO: 294.
3. Method according to item 2, wherein said DUS1L polypeptide further comprises in increasing order of preference at least 30%, 35%, 40%, 45%, 50%, 55%, 60%, 65%, 70%, 75%, 80%, 85%, 90%, 95%, 98%, 99% or more amino acid sequence identity to a polypeptide as represented by SEQ ID NO: 259.
4. Method according to any preceding item, wherein said DUS1L polypeptide has in increasing order of preference at least 30%, 35%, 40%, 45%, 50%, 55%, 60%, 65%, 70%, 75%, 80%, 85%, 90%, 95%, 98%, 99% or more amino acid sequence identity to any of the polypeptide sequences given in Table A3 herein.
5. Method according to any preceding item, wherein said DUS1L polypeptide can functionally complement an *E. coli* strain deficient in tRNA dihydrouridine synthase activity, thereby increasing tRNA dihydrouridine content.
6. Method according to any preceding item, wherein said nucleic acid sequence encoding a DUS1L polypeptide is represented by any one of the nucleic acid sequence SEQ ID NOs given in Table A3 or a portion thereof, or a sequence capable of hybridising with any one of the nucleic acid sequences SEQ ID NOs given in Table A3, or to a complement thereof.
7. Method according to any preceding item, wherein said nucleic acid sequence encodes an orthologue or paralogue of any of the polypeptide sequence SEQ ID NOs given in Table A3.
8. Method according to any preceding item, wherein said increased expression is effected by any one or more of: T-DNA activation tagging, TILLING, or homologous recombination.
9. Method according to any preceding item, wherein said increased expression is effected by introducing and expressing in a plant a nucleic acid sequence encoding a DUS1L polypeptide.
10. Method according to any preceding item, wherein said increased yield-related trait is one or more of: increased aboveground biomass, increased seed yield per plant, increased number of filled seeds, and increased total number of seeds.
11. Method according to any preceding item, wherein said yield-related trait is increased in plants grown under grown under conditions of reduced nutrient availability, particularly under conditions of reduced nitrogen availability, relative to control plants.
12. Method according to any preceding item, wherein said nucleic acid sequence is operably linked to a constitutive promoter.
13. Method according to item 11, wherein said constitutive promoter is a GOS2 promoter, preferably a GOS2 promoter from rice, most preferably a GOS2 sequence as represented by SEQ ID NO: 295.
14. Method according to any preceding item, wherein said nucleic acid sequence encoding a DUS1L polypeptide is from a plant, further preferably from a monocotyledonous plant, more preferably from the family Poaceae, most preferably the nucleic acid sequence is from *Saccharum officinarum*.
15. Plants, parts thereof (including seeds), or plant cells obtainable by a method according to any preceding item, wherein said plant, part or cell thereof comprises an isolated nucleic acid transgene encoding a DUS1L polypeptide.
16. An isolated nucleic acid molecule selected from:
    - (i) a nucleic acid sequence as represented by SEQ ID NO: 264 or by SEQ ID NO: 292;
    - (ii) the complement of a nucleic acid sequence as represented by SEQ ID NO: 264 or by SEQ ID NO: 292;
    - (iii) a nucleic acid sequence encoding a DUS1L polypeptide having, in increasing order of preference, at least 30%, 35%, 40%, 45%, 50%, 55%, 60%, 65%, 70%, 75%, 80%, 85%, 90%, 95%, 96%, 97%, 98%, 99% or more amino acid sequence identity to the polypeptide sequence represented by SEQ ID NO: 265 or by SEQ ID NO: 293.
17. An isolated polypeptide selected from:
   (i) a polypeptide sequence as represented by SEQ ID NO: 265 or by SEQ ID NO: 293;
   (ii) a polypeptide sequence having, in increasing order of preference, at least 30%, 35%, 40%, 45%, 50%, 55%, 60%, 65%, 70%, 75%, 80%, 85%, 90%, 95%, 96%, 97%, 98%, 99% or more amino acid sequence identity to a polypeptide sequence as represented by any one of SEQ ID NO: 265 or by SEQ ID NO: 293;
   (iii) derivatives of any of the polypeptide sequences given in (i) or (ii) above.
18. Construct comprising:
   (a) a nucleic acid sequence encoding a DUS1L polypeptide as defined in any one of items 1 to 7, or 16;
   (b) one or more control sequences capable of driving expression of the nucleic acid sequence of (a); and optionally
   (c) a transcription termination sequence.
19. Construct according to item 18 wherein said control sequence is a constititutve promoter.
20. Construct according to item 19 wherein said constititutve promoter is a GOS2 promoter, preferably a GOS2 promoter from rice, most preferably a GOS2 sequence as represented by SEQ ID NO: 295.
21. Use of a construct according to any one of items 18 to 20 in a method for making plants having increased yield-related traits relative to control plants, which increased yield-related traits are one or more of: increased aboveground biomass, increased seed yield per plant, increased number of filled seeds, and increased total number of seeds.
22. Plant, plant part or plant cell transformed with a construct according to any one of items 18 to 20.
23. Method for the production of transgenic plants having increased yield-related traits relative to control plants, comprising:
   (i) introducing and expressing in a plant, plant part, or plant cell, a nucleic acid sequence encoding a DUS1L polypeptide as defined in any one of items 1 to 7, or 16; and
   (ii) cultivating the plant cell, plant part, or plant under conditions promoting plant growth and development.
24. Transgenic plant having increased yield-related traits relative to control plants, resulting from increased expression of an isolated nucleic acid sequence encoding a DUS1L polypeptide as defined in any one of items 1 to 7, or 16, or a transgenic plant cell or transgenic plant part derived from said transgenic plant.
25. Transgenic plant according to item 15, 22, or 24, wherein said plant is a crop plant such as sugarbeet, or a monocot or a cereal, such as rice, maize, wheat, barley, millet, rye, triticale, *sorghum*, emmer, spelt, *secale*, teff, sugarcane, and oats, or a transgenic plant cell derived from said transgenic plant.
26. Harvestable parts comprising an isolated nucleic acid sequence encoding a DUS1L polypeptide, of a plant according to item 25, wherein said harvestable parts are preferably seeds.
27. Products derived from a plant according to item 25 and/or from harvestable parts of a plant according to item 26.
28. Use of a nucleic acid sequence encoding a DUS1L polypeptide as defined in any one of items 1 to 7, or 16, in increasing yield-related traits, comprising one or more of: increased aboveground biomass, increased seed yield per plant, increased number of filled seeds, and increased total number of seeds.

4. ES43-Like Polypeptides

1. A method for enhancing yield-related traits in plants relative to control plants, comprising modulating expression in a plant of a nucleic acid encoding an ES43-like polypeptide, said polypeptide comprising a BAH domain and a PHD domain.
2. Method according to item 1, wherein said ES43-like polypeptide comprises a domain having an amino acid sequence in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identical to the amino acid sequence of SEQ ID NO: 374 (BAH domain of SEQ ID NO: 299) or to the amino acid sequence of SEQ ID NO: 375 (PHD domain of SEQ ID NO: 299).
3. Method according to item 1 or 2, wherein said modulated expression is effected by introducing and expressing in a plant a nucleic acid encoding an ES43-like polypeptide.
4. Method according to any one of items 1 to 3, wherein said nucleic acid encoding an ES43-like polypeptide encodes any one of the proteins listed in Table A4 or is a portion of such a nucleic acid, or a nucleic acid capable of hybridising with such a nucleic acid.
5. Method according to any one of items 1 to 4, wherein said nucleic acid sequence encodes an orthologue or paralogue of any of the proteins given in Table A4.
6. Method according to any preceding item, wherein said enhanced yield-related traits comprise increased yield, preferably increased biomass and/or increased seed yield relative to control plants.
7. Method according to any one of items 1 to 6, wherein said enhanced yield-related traits are obtained under non-stress conditions.
8. Method according to any one of items 1 to 6, wherein said enhanced yield-related traits are obtained under conditions of drought stress and/or nitrogen deficiency.
9. Method according to any one of items 3 to 8, wherein said nucleic acid is operably linked to a constitutive promoter, preferably to a GOS2 promoter, most preferably to a GOS2 promoter from rice.
10. Method according to any one of items 1 to 9, wherein said nucleic acid encoding an ES43-like polypeptide is of plant origin, preferably from a dicotyledonous plant, further preferably from the family Brassicaceae, more preferably from the genus *Arabidopsis*, most preferably from *Arabidopsis thaliana*.
11. Plant or part thereof, including seeds, obtainable by a method according to any one of items 1 to 10, wherein said plant or part thereof comprises a recombinant nucleic acid encoding an ES43-like polypeptide.
12. Construct comprising:
   (a) nucleic acid encoding an ES43-like polypeptide as defined in items 1 or 2;
   (b) one or more control sequences capable of driving expression of the nucleic acid sequence of (a); and optionally
   (c) a transcription termination sequence.

13. Construct according to item 12, wherein one of said control sequences is a constitutive promoter, preferably a GOS2 promoter, most preferably a GOS2 promoter from rice.
14. Use of a construct according to item 12 or 13 in a method for making plants having increased yield, particularly increased biomass and/or increased seed yield relative to control plants.
15. Plant, plant part or plant cell transformed with a construct according to item 12 or 13.
16. Method for the production of a transgenic plant having increased yield, particularly increased biomass and/or increased seed yield relative to control plants, comprising:
    (a) introducing and expressing in a plant a nucleic acid encoding an ES43-like polypeptide as defined in item 1 or 2; and
    (b) cultivating the plant cell under conditions promoting plant growth and development.
17. Transgenic plant having increased yield, particularly increased biomass and/or increased seed yield, relative to control plants, resulting from modulated expression of a nucleic acid encoding an ES43-like polypeptide as defined in item 1 or 2, or a transgenic plant cell derived from said transgenic plant.
18. Transgenic plant according to item 11, 15 or 17, or a transgenic plant cell derived thereof, wherein said plant is a crop plant such as sugarbeet, or a monocot or a cereal, such as rice, maize, wheat, sugarcane, barley, millet, rye, triticale, *sorghum* emmer, spelt, *secale*, einkorn, teff, milo and oats.
19. Harvestable parts of a plant according to item 18, wherein said harvestable parts are preferably shoot biomass and/or seeds.
20. Products derived from a plant according to item 18 and/or from harvestable parts of a plant according to item 19.
21. Use of a nucleic acid encoding a an ES43-like polypeptide in increasing yield, particularly in increasing seed yield and/or shoot biomass in plants, relative to control plants.
22. An isolated nucleic acid molecule selected from:
    (i) a nucleic acid represented by any one of SEQ ID NO: 308, 370, and 372;
    (ii) the complement of a nucleic acid represented by any one of SEQ ID NO: 308, 370, and 372;
    (iii) a nucleic acid encoding the polypeptide as represented by any one of SEQ ID NO: 309, 371 and 373 preferably as a result of the degeneracy of the genetic code, said isolated nucleic acid can be derived from a polypeptide sequence as represented by any one of SEQ ID NO: 309, 371 and 373 and further preferably confers enhanced yield-related traits relative to control plants;
    (iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A4 and further preferably conferring enhanced yield-related traits relative to control plants;
    (v) a nucleic acid molecule which hybridizes with a nucleic acid molecule of (i) to (iv) under stringent hybridization conditions and preferably confers enhanced yield-related traits relative to control plants;
    (vi) a nucleic acid encoding a ES43-like polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 309, 371 and 373 and any of the other amino acid sequences in Table A4 and preferably conferring enhanced yield-related traits relative to control plants.
23. An isolated polypeptide selected from
    (i) an amino acid sequence represented by any one of SEQ ID NO: 309, 371 and 373;
    (ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 309, 371 and 373 and any of the other amino acid sequences in Table A4 and preferably conferring enhanced yield-related traits relative to control plants.
    (iii) derivatives of any of the amino acid sequences given in (i) or (ii) above.

5. HON5-Like Polypeptides

1. A method for enhancing yield-related traits in plants relative to control plants, comprising modulating expression in a plant of a nucleic acid encoding a HON5-like polypeptide, wherein said HONE-like polypeptide comprises a histone H1/H5 domain (Pfam: PF00538; Interpro: IPR005818) and at least two, preferably two, three, four, five, six or seven AT-hook domains (Pfam: PF02178; InterPro: IPR000637).
2. Method according to item 1, wherein said HON5-like polypeptide comprises one or more of the following motifs:

```
(i)
Motif I (SEQ ID NO: 411):
Y[ASK]EMI[YC]TAI[AGT]AL[KN][ED][PK]DGSS[KR]RAI

[AS][KR]YIERA[YF][TP][GD]LP[PS]AH[SD][AD]LLTHHLK

[RT]L[KR]

(ii)
Motif II (SEQ ID NO: 412):
GLLV[ML]VK[KH]SYKL[AP][RS]S (iii)
Motif III (SEQ ID NO: 413):
SA[PS][PQS]GQKRGRGRPPKPK
``` wherein amino acids between brackets represent alternative amino acids at that position.
3. Method according to item 1 or 2, wherein said modulated expression is effected by introducing and expressing in a plant a nucleic acid encoding a HON5-like polypeptide.
4. Method according to any one of items 1 to 3, wherein said nucleic acid encoding a HON5-like polypeptide encodes any one of the proteins listed in Table A5 or is a portion of such a nucleic acid, or a nucleic acid capable of hybridising with such a nucleic acid.

5. Method according to any one of items 1 to 4, wherein said nucleic acid sequence encodes an orthologue or paralogue of any of the proteins given in Table A5.
6. Method according to any preceding item, wherein said enhanced yield-related traits comprise increased yield, preferably increased harvest index and/or increased seed yield relative to control plants.
7. Method according to any one of items 1 to 6, wherein said enhanced yield-related traits are obtained under non-stress conditions.
8. Method according to any one of items 1 to 6, wherein said enhanced yield-related traits are obtained under conditions of drought stress, salt stress or nitrogen deficiency.
9. Method according to any one of items 3 to 8, wherein said nucleic acid is operably linked to a constitutive promoter, preferably to a GOS2 promoter, most preferably to a GOS2 promoter from rice.
10. Method according to any one of items 1 to 9, wherein said nucleic acid encoding a HON5-like polypeptide is of plant origin, preferably from a dicotyledonous plant, more preferably from the genus *Populus*, most preferably from *Populus trichocarpa*.
11. Plant or part thereof, including seeds, obtainable by a method according to any one of items 1 to 10, wherein said plant or part thereof comprises a recombinant nucleic acid encoding a HON5-like polypeptide.
12. Construct comprising:
    (i) nucleic acid encoding a HON5-like polypeptide as defined in items 1 or 2;
    (ii) one or more control sequences capable of driving expression of the nucleic acid sequence of (a); and optionally
    (iii) a transcription termination sequence.
13. Construct according to item 12, wherein one of said control sequences is a constitutive promoter, preferably a GOS2 promoter, most preferably a GOS2 promoter from rice.
14. Use of a construct according to item 12 or 13 in a method for making plants having increased yield, particularly increased harvest index and/or increased seed yield relative to control plants.
15. Plant, plant part or plant cell transformed with a construct according to item 12 or 13.
16. Method for the production of a transgenic plant having increased yield, particularly increased harvest index and/or increased seed yield relative to control plants, comprising:
    (i) introducing and expressing in a plant a nucleic acid encoding a HON5-like polypeptide as defined in item 1 or 2; and
    (ii) cultivating the plant cell under conditions promoting plant growth and development.
17. Transgenic plant having increased yield, particularly increased harvest index and/or increased seed yield, relative to control plants, resulting from modulated expression of a nucleic acid encoding a HON5-like polypeptide as defined in item 1 or 2, or a transgenic plant cell derived from said transgenic plant.
18. Transgenic plant according to item 11, 15 or 17, or a transgenic plant cell derived thereof, wherein said plant is a crop plant such as sugarbeet, or a monocot or a cereal, such as rice, maize, wheat, sugarcane, barley, millet, rye, triticale, *sorghum* emmer, spelt, *secale*, einkorn, teff, milo and oats.
19. Harvestable parts of a plant according to item 18, wherein said harvestable parts are preferably shoot biomass and/or seeds.
20. Products derived from a plant according to item 18 and/or from harvestable parts of a plant according to item 19.
21. Use of a nucleic acid encoding a HON5-like polypeptide in increasing yield, particularly in increasing seed yield and/or harvest index in plants, relative to control plants.
22. A isolated nucleic acid molecule selected from:
    (i) a nucleic acid represented by any one of SEQ ID NO: 393 and 395;
    (ii) the complement of a nucleic acid represented by any one of SEQ ID NO: 393 and 395;
    (iii) a nucleic acid encoding the polypeptide as represented by any one of SEQ ID NO: 394 and 396 preferably as a result of the degeneracy of the genetic code, said isolated nucleic acid can be derived from a polypeptide sequence as represented by any one of SEQ ID NO: 394 and 396 and further preferably confers enhanced yield-related traits relative to control plants;
    (iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A5 and further preferably conferring enhanced yield-related traits relative to control plants;
    (v) a nucleic acid molecule which hybridizes with a nucleic acid molecule of (i) to (iv) under stringent hybridization conditions and preferably confers enhanced yield-related traits relative to control plants;
    (vi) a nucleic acid encoding a HON5-like polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 394 and 396 and any of the other amino acid sequences in Table A5 and preferably conferring enhanced yield-related traits relative to control plants.
23. An isolated polypeptide selected from:
    (i) an amino acid sequence represented by any one of SEQ ID NO: 394 and 396;
    (ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 394 and 396 and any of the other amino acid sequences in Table A5 and preferably conferring enhanced yield-related traits relative to control plants.
    (iii) derivatives of any of the amino acid sequences given in (i) or (ii) above.

6. glutamate-1-semialdehyde aminotransferase polypeptides (GSA1 polypeptides)

1. A method for enhancing yield-related traits in plants relative to control plants, comprising modulating expression in a plant of a nucleic acid encoding a GSA1 polypeptide, wherein said GSA1 polypeptide comprises one or more of Domains 1 to 3:

(SEQ ID NO: 487)
Domain 1:
VPS[IV]EMVRFVNSGTEAC[ML][GS][VA]LRL[AM]RA[FY]TGREK
[IV][IL]KFEGCYHGHAD[PS]FLVK (SEQ ID NO: 488)
Domain 2:
SPVRAFKSVGGQP[IV]V[FI]D[SR]VKG[SA][HRY][MA]WD[IV]D
GN[EK]Y[IV]DYVGSWGPAIIGHADD (SEQ ID NO: 489)
Domain 3:
AQEYFGITPD[LV]TT[LM]GK[IV]IGGGLPVGAYGG[RK][RK][ED]
IMEMVAPAGPMYQAGTLS or a domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to any one or more of Domains 1 to 3.

2. Method according to item 1, wherein said modulated expression is effected by introducing and expressing in a plant a nucleic acid encoding a GSA1 polypeptide.

3. Method according to item 1 or 2, wherein said nucleic acid encoding a GSA1 polypeptide encodes any one of the proteins listed in Table A6 or is a portion of such a nucleic acid, or a nucleic acid capable of hybridising with such a nucleic acid.

4. Method according to any one of items 1 to 3, wherein said nucleic acid sequence encodes an orthologue or paralogue of any of the proteins given in Table A6.

5. Method according to any preceding item, wherein said enhanced yield-related traits comprise increased yield, preferably increased biomass and/or increased seed yield relative to control plants.

6. Method according to any one of items 1 to 6, wherein said enhanced yield-related traits are obtained under conditions of drought stress.

7. Method according to any one of items 2 to 6, wherein said nucleic acid is operably linked to a constitutive promoter, preferably to a GOS2 promoter, most preferably to a GOS2 promoter from rice.

8. Method according to any one of items 1 to 7, wherein said nucleic acid encoding a GSA1 polypeptide is of plant origin, preferably from a dicotyledonous plant, further preferably from the family Salicaceae, more preferably from the genus *Populus*, most preferably from *Populus trichocarpa*.

9. Plant or part thereof, including seeds, obtainable by a method according to any one of items 1 to 8, wherein said plant or part thereof comprises a recombinant nucleic acid encoding a GSA1 polypeptide.

10. Construct comprising:
(i) nucleic acid encoding a GSA1 polypeptide as defined in item 1;
(ii) one or more control sequences capable of driving expression of the nucleic acid sequence of (a); and optionally
(iii) a transcription termination sequence.

11. Construct according to item 10, wherein one of said control sequences is a constitutive promoter, preferably a GOS2 promoter, most preferably a GOS2 promoter from rice.

12. Use of a construct according to item 10 or 11 in a method for making plants having increased yield, particularly increased biomass and/or increased seed yield relative to control plants.

13. Plant, plant part or plant cell transformed with a construct according to item 10 or 11.

14. Method for the production of a transgenic plant having increased yield, particularly increased biomass and/or increased seed yield relative to control plants, comprising:
(i) introducing and expressing in a plant a nucleic acid encoding a GSA1 polypeptide as defined in item 1; and
(ii) cultivating the plant cell under conditions promoting plant growth and development.

15. Transgenic plant having increased yield, particularly increased biomass and/or increased seed yield, relative to control plants, resulting from modulated expression of a nucleic acid encoding a GSA1 polypeptide as defined in item 1, or a transgenic plant cell derived from said transgenic plant.

16. Transgenic plant according to item 9, 13 or 15, or a transgenic plant cell derived thereof, wherein said plant is a crop plant such as sugarbeet, or a monocot or a cereal, such as rice, maize, wheat, sugarcane, barley, millet, rye, triticale, *sorghum* emmer, spelt, *secale*, einkorn, teff, milo and oats.

17. Harvestable parts of a plant according to item 16, wherein said harvestable parts are preferably shoot biomass and/or seeds.

18. Products derived from a plant according to item 16 and/or from harvestable parts of a plant according to item 17.

19. Use of a nucleic acid encoding a GSA1 polypeptide in increasing yield, particularly in increasing seed yield and/or shoot biomass in plants, relative to control plants.

EXAMPLES

The present invention will now be described with reference to the following examples, which are by way of illustration alone. The following examples are not intended to completely define or otherwise limit the scope of the invention.

DNA manipulation: unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

Example 1

Identification of Sequences Related to the Nucleic Acid Sequence Used in the Methods of the Invention Sequences (full length cDNA, ESTs or genomic) related to the nucleic acid sequence used in the methods of the present invention were identified inter alia amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid used in the present invention was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

1.1. BET1-Like Polypeptides

Table A1 provides a list of nucleic acid sequences related to the nucleic acid sequence used in the methods of the present invention.

TABLE A1

Examples of BET1-like polypeptides:

| BET1-like polypeptides | Nucleic acid SEQ ID NO: | Polypeptide SEQ ID NO: |
|---|---|---|
| T----M---___25296 | 1 | 2 |
| A. arenosa_x_thaliana__TA52__378006__1 | 3 | 4 |
| A. hypogaea__EE124570__1 | 5 | 6 |
| A. majus__AJ789814__1 | 7 | 8 |
| A. thaliana__AT1G56233.1__1 | 9 | 10 |
| B. napus__BN06MS42331943.f_k04__1__40488__1 | 11 | 12 |
| B. napus__CD815839__1 | 13 | 14 |
| B. pendula__CD278481__1 | 15 | 16 |
| B. vulgaris__DV501764__1 | 17 | 18 |
| C. reticulata_x_temple__DN795225__1 | 19 | 20 |
| C. tetragonoloba__EG981304__1 | 21 | 22 |
| C. tetragonoloba__EG987480__1 | 23 | 24 |
| G. biloba__DR064764__1 | 25 | 26 |
| G. max__TA67390__3847__1 | 27 | 28 |
| L. serriola__TA5233__75943__1 | 29 | 30 |
| M. truncatula__AC169182__23.5__1 | 31 | 32 |
| M. truncatula__AC169182__39.5__1 | 33 | 34 |
| P. abies__TA1522__3329__1 | 35 | 36 |
| P. abies__TA1523__3329__1 | 37 | 38 |
| P. abies__TA2417__3329__1 | 39 | 40 |
| P. coccineus__CA908259__1 | 41 | 42 |
| P. coccineus__CA908272__1 | 43 | 44 |
| P. coccineus__TA2699__3886__1 | 45 | 46 |
| P. coccineus__TA3810__3886__1 | 47 | 48 |
| P. dulcis__TA313__3755__1 | 49 | 50 |
| P. engelmannii_x_glauca__CO203682__1 | 51 | 52 |
| P. menziesii__TA1952__3357__1 | 53 | 54 |
| P. pinaster__BX678743__1 | 55 | 56 |
| P. pinaster__BX682074__1 | 57 | 58 |
| P. pinaster__CR392675__1 | 59 | 60 |
| P. pinaster__TA4836__71647__1 | 61 | 62 |
| P. pinaster__TA4882__71647__1 | 63 | 64 |
| P. sitchensis__TA10405__3332__1 | 65 | 66 |
| P. taeda__CO162523__1 | 67 | 68 |
| P. taeda__TA16676__3352__1 | 69 | 70 |
| P. taeda__TA22888__3352__1 | 71 | 72 |
| P. taeda__TA3629__3352__1 | 73 | 74 |
| P. taeda__TA4949__3352__1 | 75 | 76 |

TABLE A1-continued

Examples of BET1-like polypeptides:

| BET1-like polypeptides | Nucleic acid SEQ ID NO: | Polypeptide SEQ ID NO: |
|---|---|---|
| S. indicum__TA1114__4182__1 | 77 | 78 |
| V. corymbosum__CV091429__1 | 79 | 80 |
| V. corymbosum__DR068079__1 | 81 | 82 |
| V. riparia__TA839__96939__1 | 83 | 84 |
| Z. mays__c57759235gm030403__14494__1 | 85 | 86 |
| Z. mays__c62091609gm030403__7698__1 | 87 | 88 |
| Z. mays__DQ245377__1 | 89 | 90 |
| Z. mays__DR787277__1 | 91 | 92 |
| Z. mays__EC364520__1 | 93 | 94 |
| Z. mays__ZM07MC13625__57676372__13595__1 | 95 | 96 |

1.2. Calreticulin Polypeptides

Table A2 provides a list of nucleic acid sequences related to the nucleic acid sequence used in the methods of the present invention.

TABLE A2

Examples of Calreticulin polypeptides:

| Name | Nucleic acid SEQ ID NO: | Polypeptide SEQ ID NO: |
|---|---|---|
| S. lycopersicum__TA36564 | 104 | 105 |
| A. formosa__TA9419 | 106 | 107 |
| A. thaliana__AT1G09210__CRT2 | 108 | 109 |
| A. thaliana__AT1G56340__CRT1 | 110 | 111 |
| A. trichopoda__TA1102 | 112 | 113 |
| B. distachyon__TA448 | 114 | 115 |
| B. napus__BPS__28478 | 116 | 117 |
| B. napus__TA20659 | 118 | 119 |
| B. vulgaris__TA7257 | 120 | 121 |
| C. annuum__TA4292 | 122 | 123 |
| C. endivia__TA1106 | 124 | 125 |
| C. solstitialis__TA9 | 126 | 127 |
| G. hirsutum__TA20990 | 128 | 129 |
| G. max__BPS__38275 | 130 | 131 |
| G. raimondii__TA8857 | 132 | 133 |
| G. raimondii__TA8860 | 134 | 135 |
| H. annuus__TA7525 | 136 | 137 |
| H. argophyllus__TA1300 | 138 | 139 |
| H. vulgare__BPS__7785 | 140 | 141 |
| H. vulgare__TA38555 | 142 | 143 |
| I. nil__TA5002 | 144 | 145 |
| L. japonicus__TA548 | 146 | 147 |
| L. serriola__TA711 | 148 | 149 |
| M. domestica__TA24948 | 150 | 151 |
| M. truncatula__AC149474 | 152 | 153 |
| O. basilicum__TA646 | 154 | 155 |
| O. sativa__Os03g0832200 | 156 | 157 |
| O. sativa__Os07g0246200 | 158 | 159 |
| P. persica__TA3474 | 160 | 161 |
| P. pinaster__TA4383 | 162 | 163 |
| P. sitchensis__TA20930 | 164 | 165 |
| P. taeda__TA5639 | 166 | 167 |
| P. trichocarpa__133.107 | 168 | 169 |
| P. trichocarpa__729432 | 170 | 171 |
| P. vulgaris__TA3122 | 172 | 173 |
| R. communis__U74630 | 174 | 175 |
| S. bicolor__TA20922 | 176 | 177 |
| S. bicolor__TA25211 | 178 | 179 |
| S. habrochaites__TA1435 | 180 | 181 |
| S. tuberosum__TA24720 | 182 | 183 |
| T. aestivum__TA50840 | 184 | 185 |
| T. aestivum__TA74192 | 186 | 187 |
| V. vinifera__TA38405 | 188 | 189 |
| W. mirabilis__TA538 | 190 | 191 |
| Z. mays__TA170881 | 192 | 193 |
| A. formosa__TA8804 | 194 | 195 |
| A. thaliana__AT1G08450__CRT3 | 196 | 197 |

TABLE A2-continued

Examples of Calreticulin polypeptides:

| Name | Nucleic acid SEQ ID NO: | Polypeptide SEQ ID NO: |
|---|---|---|
| B. napus_BPS_33882 | 198 | 199 |
| C. maculosa_TA223 | 200 | 201 |
| E. esula_TA10075 | 202 | 203 |
| G. raimondii_TA11257 | 204 | 205 |
| H. vulgare_TA32081 | 206 | 207 |
| M. domestica_TA28184 | 208 | 209 |
| M. truncatula_TA23636 | 210 | 211 |
| O. sativa_Os01g67054.1 | 212 | 213 |
| O. sativa_Os05g43170.1 | 214 | 215 |
| P. patens_164102 | 216 | 217 |
| P. trichocarpa_VII.148 | 218 | 219 |
| P. trifoliata_TA7309 | 220 | 221 |
| S. bicolor_TA24664 | 222 | 223 |
| T. aestivum_TA53764 | 224 | 225 |
| V. vinifera_GSVIVT00025039001 | 226 | 227 |
| Z. mays_BPS_22383 | 228 | 229 |
| Z. mays_TA15627 | 230 | 231 |
| C. reinhardtii_TA11983 | 232 | 233 |
| V. carteri_76046 | 234 | 235 |
| D. melanogaster_CRC | 236 | 237 |
| H. sapien_CALR3 | 238 | 239 |
| H. sapien_CALRE | 240 | 241 |
| A. anophagefferens_21695 | 242 | 243 |
| P. tricornutum_41172 | 244 | 245 |

1.3. tRNA Dihydrouridine Synthase 1-Like Polypeptides (DUS1L Polypeptides)

Table A3 provides a list of nucleic acid sequences related to the nucleic acid sequence used in the methods of the present invention.

TABLE A3

Examples of DUS1L polypeptide sequences, and encoding nucleic acid sequences

| Name | Nucleic acid SEQ ID NO | Polypeptide SEQ ID NO |
|---|---|---|
| Sacof_DUS1L | 258 | 259 |
| A. thaliana_AT5G67220.1 | 260 | 261 |
| B. napus_TC79818 | 262 | 263 |
| B. napus_BN06MC20455_46646511@20387 (P) | 264 | 265 |
| C. vulgaris_36290 | 266 | 267 |
| E. huxleyi_437158 | 268 | 269 |
| G. max_Glyma17g18490.1 | 270 | 271 |
| G. max_Glyma05g20510.1 | 272 | 273 |
| O. sativa_LOC_Os06g49870.1 | 274 | 275 |
| P. patens_149014 | 276 | 277 |
| P. taeda_TA13257_3352 | 278 | 279 |
| R. communis_TA2745_3988 | 280 | 281 |
| S. moellendorffii_443602 | 282 | 283 |
| S. lycopersicum_TC206234 | 284 | 285 |
| S. bicolor_Sb10g029830.1 | 286 | 287 |
| V. vinifera_GSVIVT00019548001 | 288 | 289 |
| V. carteri_80128 | 290 | 291 |
| Z. mays_ZM07MC04636_BFb0070D07@4625 (P) | 292 | 293 |

In some instances, related sequences have tentatively been assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute. Further, access to proprietary databases (P), has allowed the identification of novel nucleic acid and polypeptide sequences.

1.4. ES43-Like Polypeptides

Table A4 provides a list of nucleic acid sequences related to the nucleic acid sequence used in the methods of the present invention.

TABLE A4

Examples of ES43-like polypeptides:

| Name ES43-like polypeptides | Nucleic acid SEQ ID NO: | Polypeptide SEQ ID NO: |
|---|---|---|
| T___M___---_29382; ---4312; 116; 772; 4530; 39#1 | 298 | 299 |
| A. thaliana_AT4G22140.1#1 | 300 | 301 |
| A. thaliana_AT4G22140.2#1 | 302 | 303 |
| A. thaliana_AT4G39100.1#1 | 304 | 305 |
| A. thaliana_AT4G04260.1#1 | 306 | 307 |
| B. napus_BN06MC06825_42494234@6808#1 | 308 | 309 |
| H. vulgare_TA35269_4513#1 | 310 | 311 |
| H. vulgare_TA42493_4513#1 | 312 | 313 |
| H. vulgare_BF623189#1 | 314 | 315 |
| H. vulgare_TA40508_4513#1 | 316 | 317 |
| L. usitatissimum_LU04MC11049_62370147@11045#1 | 318 | 319 |
| O. sativa_Os09g0386500#1 | 320 | 321 |
| O. sativa_Os08g0421900#1 | 322 | 323 |
| O. sativa_Os07g0186400#1 | 324 | 325 |
| O. sativa_AK061201#1 | 326 | 327 |
| O. sativa_Os03g0799600#1 | 328 | 329 |
| P. patens_153027#1 | 330 | 331 |
| P. patens_149469#1 | 332 | 333 |
| P. patens_108696#1 | 334 | 335 |
| P. patens_59496#1 | 336 | 337 |
| P. patens_213413#1 | 338 | 339 |
| P. trichocarpa_scaff_IV.1226#1 | 340 | 341 |
| P. trichocarpa_scaff_XIV.1045#1 | 342 | 343 |
| P. trichocarpa_scaff_XI.104#1 | 344 | 345 |
| P. trichocarpa_scaff_1247.1#1 | 346 | 347 |
| P. trichocarpa_scaff_166.34#1 | 348 | 349 |
| P. trichocarpa_scaff_II.2065#1 | 350 | 351 |
| S. lycopersicum_TA42220_4081#1 | 352 | 353 |
| S. lycopersicum_TA40478_4081#1 | 354 | 355 |
| T___M___---_2176; ---0490; 46; 822; 3702; 32#1 | 356 | 357 |
| T___M___---_14367; ---4367; 137; 787; 4565; 23#1 | 358 | 359 |
| T. aestivum_TA54637_4565#1 | 360 | 361 |
| T. aestivum_CK201479#1 | 362 | 363 |
| T. aestivum_c54968390@13747#1 | 364 | 365 |
| Z. mays_TA19459_4577999#1 | 366 | 367 |
| Z. mays_TA12947_4577999#1 | 368 | 369 |
| Z. mays_ZM07MC24083_BFb0146O24@24016#1 | 370 | 371 |
| Z. mays_ZM07MC24174_BFb0045F09@24106#1 | 372 | 373 |

In some instances, related sequences have tentatively been assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute. Further, access to proprietary databases, has allowed the identification of novel nucleic acid and polypeptide sequences.

1.5. HON5-Like Polypeptides

Table A5 provides a list of nucleic acid sequences related to the nucleic acid sequence used in the methods of the present invention.

TABLE A5

Examples of HON5-like polypeptides:

| Name | Organism name | Nucleic acid SEQ ID NO: | Polypeptide SEQ ID NO: |
|---|---|---|---|
| Poptr_HMGA905 | Populus trichocarpa | 387 | 388 |
| Arath_HMGA2 | Arabidsopsis thaliana | 389 | 390 |
| Arath_Hon4 | Arabidsopsis thaliana | 391 | 392 |
| Brana_Hon5\like | Brassica napus | 393 | 394 |
| Glyma_HON5\like | Glycine max | 395 | 396 |
| Gosar_HMGA10101 | Gossypium arboretum | 397 | 398 |
| Alcep_HMGA14201 | Allium cepa | 399 | 400 |
| Lotja_HMGA1701 | Lotus japonica | 401 | 402 |
| Orysa_HMGA2201 | Oryza sative | 403 | 404 |
| Poptr_HMGA906 | Populus trichocarpa | 405 | 406 |
| Sacof_HMGA2503 | Saccharum officinarum | 407 | 408 |
| Vitvi_hon5\like | Vitis vinifera |  | 409 |

In some instances, related sequences have tentatively been assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute. Further, access to proprietary databases, has allowed the identification of novel nucleic acid and polypeptide sequences.

1.6. glutamate-1-semialdehyde aminotransferase polypeptides (GSA1 polypeptides)

Table A6 provides a list of nucleic acid sequences related to the nucleic acid sequence used in the methods of the present invention.

TABLE A6

Examples of GSA1 polypeptides:

| Name | Nucleic acid SEQ ID NO: | Polypeptide SEQ ID NO: |
|---|---|---|
| ===5613 | 417 | 418 |
| A_thaliana_AT3G48730_1 | 419 | 420 |
| A_thaliana_AT5G63570_1 | 421 | 422 |
| Aquilegia_sp_TC22821 | 423 | 424 |
| B_napus_TC63445 | 425 | 426 |
| B_napus_TC63450 | 427 | 428 |
| C_reinhardtii_138524 | 429 | 430 |
| C_vulgaris_43392 | 431 | 432 |
| Chlorella_37143 | 433 | 434 |
| E_huxleyi_437052 | 435 | 436 |
| F_arundinacea_TC6452 | 437 | 438 |
| F_vesca_TA11529_57918 | 439 | 440 |
| G_max_Glyma04g00420_1 | 441 | 442 |
| G_max_Glyma06g00510_1 | 443 | 444 |
| H_vulgare_TC162130 | 445 | 446 |
| M_truncatula_CU024868_27_4 | 447 | 448 |
| N_benthamiana_TC14122 | 449 | 450 |
| N_tabacum_TC18263 | 451 | 452 |
| N_tabacum_TC18710 | 453 | 454 |
| O_lucimarinus_28523 | 455 | 456 |
| O_RCC809_53004 | 457 | 458 |
| O_sativa_LOC_Os08g41990_1 | 459 | 460 |
| O_taurii_24711 | 461 | 462 |
| P_patens_116325 | 463 | 464 |
| P_patens_181992 | 465 | 466 |
| P_tremuloides_575404 | 467 | 468 |

TABLE A6-continued

Examples of GSA1 polypeptides:

| Name | Nucleic acid SEQ ID NO: | Polypeptide SEQ ID NO: |
|---|---|---|
| P_tricornutum_36347 | 469 | 470 |
| R_communis_TA2570_3988 | 471 | 472 |
| S_lycopersicum_TC191683 | 473 | 474 |
| S_moellendorffii_183248 | 475 | 476 |
| T_aestivum_TA06MC000384_60074805_384 | 477 | 478 |
| T_pseudonana_575 | 479 | 480 |
| V_carteri_74470 | 481 | 482 |
| V_shuttleworthii_TA2337_246827 | 483 | 484 |
| Z_mays_ZM07MC17771_BFb0062K01_17727 | 485 | 486 |

In some instances, related sequences have tentatively been assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute. Further, access to proprietary databases, has allowed the identification of novel nucleic acid and polypeptide sequences.

Example 2

Alignment of Sequences Related to the Polypeptide Sequences Used in the Methods of the Invention 2.1. BET1-Like Polypeptides Alignment of polypeptide sequences was performed using the ClustalW 2.0 algorithm of progressive alignment (Thompson et al. (1997) Nucleic Acids Res 25:4876-4882; Chema et al. (2003). Nucleic Acids Res 31:3497-3500) with Blosum 62 matrix, gap opening penalty 10, gap extension penalty: 0.2). Minor manual editing was done to further optimise the alignment. The BET1-like polypeptides are aligned in FIG. 2.

Highly conserved amino acid residues are indicated in the consensus sequence.

2.2. Calreticulin Polypeptides

Alignment of polypeptide sequences of plant origin of Table A2 was performed using the ClustalW 2.0 algorithm of progressive alignment (Thompson et al. (1997) Nucleic Acids Res 25:4876-4882; Chema et al. (2003). Nucleic Acids Res 31:3497-3500) with standard setting (slow alignment, similarity matrix: Blosum 62 (gap opening penalty 10, gap extension penalty: 0.2). Minor manual editing was done to further optimise the alignment. The Calreticulin polypeptides are aligned in FIG. 4. Highly conserved amino acid residues are indicated in the consensus sequence.

Figure 5:
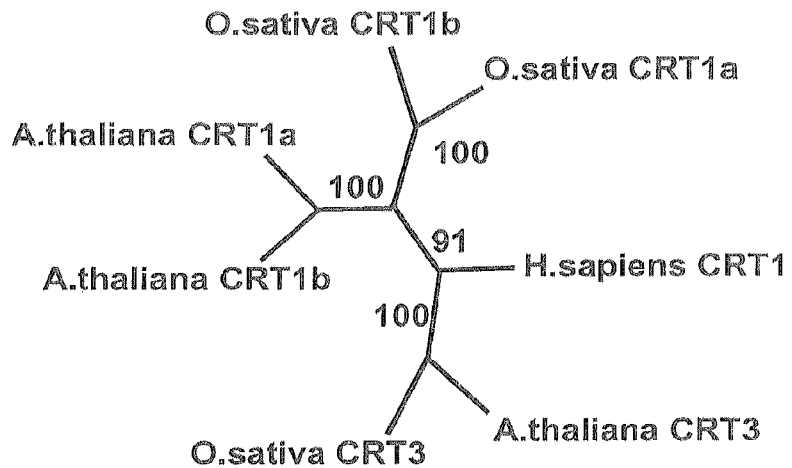
FIG. 5 shows phylogenetic tree as described by Christensen et al. 2008 FIG. 1A.

A phylogenetic tree of Calreticulin polypeptides of plant origin is reproduced from Christensen et al. 2008 (FIG. 5).

A phylogenetic tree of the Calreticulin polypeptides of Table A2 was constructed using a neighbour-joining clustering algorithm as provided in the AlignX programme from the Vector NTI (Invitrogen). The Calreticulin polypeptides origin clustered in 5 distinct clades: 1-CRT1, comprising Calreticulin polypeptides of plant origin of the Group CRT1/2; 2-CRT3, comprising Calreticulin polypeptides of plant origin of the Group CRT3; 3-algae: comprising Calreticulin polypeptides of origating from algae; 4-animal: comprising Calreticulin polypeptides of originating from the animal kingdom. Table B1 shows the distribution of the polypeptides of Table A2 amongst the different clades.

TABLE B1

Phylogentic relationship of Calreticulin polypeptides.

| Name | SEQ ID NO: | Clade |
|---|---|---|
| S. lycopersicum__TA36564 | 105 | 1-CRT1 |
| A. formosa__TA9419 | 107 | 1-CRT1 |
| A. thaliana__AT1G09210__CRT2 | 109 | 1-CRT1 |
| A. thaliana__AT1G56340__CRT1 | 111 | 1-CRT1 |
| A. trichopoda__TA1102 | 113 | 1-CRT1 |
| B. distachyon__TA448 | 115 | 1-CRT1 |
| B. napus__BPS__28478 | 117 | 1-CRT1 |
| B. napus__TA20659 | 119 | 1-CRT1 |
| B. vulgaris__TA7257 | 121 | 1-CRT1 |
| C. annuum__TA4292 | 123 | 1-CRT1 |
| C. endivia__TA1106 | 125 | 1-CRT1 |
| C. solstitialis__TA9 | 127 | 1-CRT1 |
| G. hirsutum__TA20990 | 129 | 1-CRT1 |
| G. max__BPS__38275 | 131 | 1-CRT1 |
| G. raimondii__TA8857 | 133 | 1-CRT1 |
| G. raimondii__TA8860 | 135 | 1-CRT1 |
| H. annuus__TA7525 | 137 | 1-CRT1 |
| H. argophyllus__TA1300 | 139 | 1-CRT1 |
| H. vulgare__BPS__7785 | 141 | 1-CRT1 |
| H. vulgare__TA38555 | 143 | 1-CRT1 |
| I. nil__TA5002 | 145 | 1-CRT1 |
| L. japonicus__TA548 | 147 | 1-CRT1 |
| L. serriola__TA711 | 149 | 1-CRT1 |
| M. domestica__TA24948 | 151 | 1-CRT1 |
| M. truncatula__AC149474 | 153 | 1-CRT1 |
| O. basilicum__TA646 | 155 | 1-CRT1 |
| O. sativa__Os03g0832200 | 157 | 1-CRT1 |
| O. sativa__Os07g0246200 | 159 | 1-CRT1 |
| P. persica__TA3474 | 161 | 1-CRT1 |
| P. pinaster__TA4383 | 163 | 1-CRT1 |
| P. sitchensis__TA20930 | 165 | 1-CRT1 |
| P. taeda__TA5639 | 167 | 1-CRT1 |
| P. trichocarpa__133.107 | 169 | 1-CRT1 |
| P. trichocarpa__729432 | 171 | 1-CRT1 |
| P. vulgaris__TA3122 | 173 | 1-CRT1 |
| R. communis__U74630 | 175 | 1-CRT1 |
| S. bicolor__TA20922 | 177 | 1-CRT1 |
| S. bicolor__TA25211 | 179 | 1-CRT1 |
| S. habrochaites__TA1435 | 181 | 1-CRT1 |
| S. tuberosum__TA24720 | 183 | 1-CRT1 |
| T. aestivum__TA50840 | 185 | 1-CRT1 |
| T. aestivum__TA74192 | 187 | 1-CRT1 |
| V. vinifera__TA38405 | 189 | 1-CRT1 |
| W. mirabilis__TA538 | 191 | 1-CRT1 |
| Z. mays__TA170881 | 193 | 1-CRT1 |
| A. formosa__TA8804 | 195 | 2-CRT3 |
| A. thaliana__AT1G08450__CRT3 | 197 | 2-CRT3 |
| B. napus__BPS__33882 | 199 | 2-CRT3 |
| C. maculosa__TA223 | 201 | 2-CRT3 |
| E. esula__TA10075 | 203 | 2-CRT3 |
| G. raimondii__TA11257 | 205 | 2-CRT3 |
| H. vulgare__TA32081 | 207 | 2-CRT3 |
| M. domestica__TA28184 | 209 | 2-CRT3 |
| M. truncatula__TA23636 | 211 | 2-CRT3 |
| O. sativa__Os01g67054.1 | 213 | 2-CRT3 |
| O. sativa__Os05g43170.1 | 215 | 2-CRT3 |
| P. patens__164102 | 217 | 2-CRT3 |
| P. trichocarpa__VII.148 | 219 | 2-CRT3 |
| P. trifoliata__TA7309 | 221 | 2-CRT3 |
| S. bicolor__TA24664 | 223 | 2-CRT3 |
| T. aestivum__TA53764 | 225 | 2-CRT3 |
| V. vinifera__GSVIVT00025039001 | 227 | 2-CRT3 |
| Z. mays__BPS__22383 | 229 | 2-CRT3 |
| Z. mays__TA15627 | 231 | 2-CRT3 |
| C. reinhardtii__TA11983 | 233 | 3-algae |
| V. carteri__76046 | 235 | 3-algae |
| D. melanogaster__CRC | 237 | 4-animal |
| H. sapien__CALR3 | 239 | 4-animal |
| H. sapien__CALRE | 241 | 4-animal |
| A. anophagefferens__21695 | 243 | 5-protist |
| P. tricornutum__41172 | 245 | 5-protist |

2.3. tRNA Dihydrouridine Synthase 1-Like Polypeptides (DUS1L Polypeptides)

Multiple sequence alignment of all the DUS1L polypeptide sequences in Table A3 was performed using the AlignX algorithm (from Vector NTI 10.3, Invitrogen Corporation). Results of the alignment are shown in FIG. 9 of the present application. One important domain is a tRNA-dihydrouridine synthase domain with an InterPro entry IPR001269 (integrating the PFAM PF01207 entry (marked by X's). One important motif is the tRNA-dihydrouridine synthase conserved site with an InterPro entry IPR018517 (integrating the PROSITE PS01136 (marked by X's, in bold in SEQ ID NO: Sacof_DUS1L). Conserved residues are heavily boxed, in particular a Cys residue which is in other organisms a key general-acid/base catalyst.

2.4. ES43-Like Polypeptides

Alignment of polypeptide sequences was performed using the ClustalW 1.8 algorithm of progressive alignment (Thompson et al. (1997) Nucleic Acids Res 25:4876-4882; Chema et al. (2003). Nucleic Acids Res 31:3497-3500) with standard setting (slow alignment, similarity matrix: Gonnet, gap opening penalty 10, gap extension penalty: 0.2). Minor manual editing was done to further optimise the alignment. The ES43-like polypeptides are aligned in FIG. 12.

The sequence and location of the BAH and the PHD domains in the ES43-like polypeptides of Table A4 becomes apparent when looking at FIG. 11 and FIG. 12.

2.5. HON5-Like Polypeptides

Alignment of polypeptide sequences was performed using the ClustalW 2.0 algorithm of progressive alignment (Thompson et al. (1997) Nucleic Acids Res 25:4876-4882; Chema et al. (2003). Nucleic Acids Res 31:3497-3500) with standard setting and Blosum 62 matrix, gap opening penalty 10, gap extension penalty 0.2 as provided by the AlignX programme from Vector NTI (Invitrogen). Minor manual editing was done to further optimise the alignment. The HON5-like polypeptides are aligned in FIG. 14. Amino acid residues highly conserved are indicated in the consensus sequence. The HI/H5 domain and the AThook domains (6 in total) are indicated.

2.6. glutamate-1-semialdehyde aminotransferase polypeptides (GSA1 polypeptides)

Alignment of polypeptide sequences was performed using the ClustalW 2.0 algorithm of progressive alignment (Thompson et al. (1997) Nucleic Acids Res 25:4876-4882; Chema et al. (2003). Nucleic Acids Res 31:3497-3500) with standard setting (slow alignment, similarity matrix: Gonnet (or Blosum 62)., gap opening penalty 10, gap extension penalty: 0.2). Minor manual editing was done to further optimise the alignment. The GSA1 polypeptides are aligned in FIG. 16.

A phylogenetic tree of GSA1 polypeptides (FIG. 17) was constructed using a neighbour-joining clustering algorithm as provided in the AlignX programme from Vector NTI (Invitrogen).

Example 3

Calculation of Global Percentage Identity Between Polypeptide Sequences Useful in Performing the Methods of the Invention 3.1. BET1-Like Polypeptides Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table C1 for the global similarity and identity over the full length of the polypeptide sequences. Percentage identity is given above the diagonal in bold and percentage similarity is given below the diagonal (normal face).

The percentage identity between the BET1-like polypeptide sequences useful in performing the methods of the invention can be as low as 25% % amino acid identity compared to SEQ ID No: 2 (Table C1).

Scoring matrix: Blosum62
First Gap: 12
Extending gap: 2

The percentage identity between Calreticulin polypeptide sequences useful in performing the methods of the invention can be as low as 32% amino acid identity. The percentage identity between Calreticulin polypeptide sequences of the CRT1/2 is typically at least 64%. The percentage identity between Calreticulin polypeptide sequences of the CRT3 is typically at least 55%. The percentage identity of Calreticulin polypeptide sequences of the CRT1/2 group compared to Calreticulin polypeptide sequences of the CRT3 group is typically at least 49%.

3.3. tRNA Dihydrouridine Synthase 1-Like Polypeptides (DUS1L Polypeptides)

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example

TABLE C1

MatGAT results for global similarity and identity over the full length of the polypeptide sequences.

| BET1-like polypeptide | 1 | 17 | 24 | 38 | 41 | 42 | 43 | 44 | 46 |
|---|---|---|---|---|---|---|---|---|---|
| 1. M. truncatula__AC169182__39.5__1 |  | 32.1 | 24.4 | 26.1 | 26.4 | 29 | 22.8 | 22.8 | 26.1 |
| 17. M. truncatula__AC169182__23.5__1 | 40.5 |  | 21.6 | 24.2 | 22 | 26 | 23.7 | 23.7 | 24.2 |
| 24. B. napus__BN06MS42331943.f_k04__1__40488__1 | 32.1 | 38.3 |  | 23.9 | 20.4 | 25 | 31.6 | 30.5 | 23.9 |
| 38. T----M---____25296 | 34.1 | 41.2 | 41.2 |  | 25 | 28.9 | 65.6 | 66.7 | 93.3 |
| 41. A. thaliana__AT1G56233.1__1 | 40.2 | 40.2 | 43.7 | 42.5 |  | 17.9 | 17.1 | 17.1 | 23.2 |
| 42. Z. mays__c57759235gm030403__14494__1 | 38.2 | 44.9 | 40.4 | 50.6 | 37.1 |  | 30.2 | 29.2 | 28.7 |
| 43. Z. mays__c62091609gm030403__7698__1 | 33.7 | 40.4 | 46.1 | 77.5 | 40.4 | 51.7 |  | 97.8 | 67 |
| 44. Z. mays__DQ245377__1 | 33.7 | 40.4 | 44.9 | 77.5 | 40.4 | 51.7 | 100 |  | 68.1 |
| 46. Z. mays__ZM07MC13625__57676372__13595__1 | 33.7 | 39.3 | 39.3 | 95.5 | 41.6 | 50.6 | 78.7 | 78.7 |  |

3.2. Calreticulin Polypeptides

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity were shown in the top half of the diagonal dividing line.

Blosum 62 (for polypeptides), and then places the results in a distance matrix. Sequence similarity is shown in the bottom half of the dividing line and sequence identity is shown in the top half of the diagonal dividing line.

Parameters used in the comparison were:

Scoring matrix: Blosum62

First Gap: 12

Extending gap: 2

Results of the software analysis are shown in Table C2 for the global similarity and identity over the full length of the polypeptide sequences (excluding the partial polypeptide sequences).

The percentage identity between the full length polypeptide sequences useful in performing the methods of the invention can be as low as 32% amino acid identity compared to SEQ ID NO: 259.

TABLE C2

MatGAT results for global similarity and identity over the full length of the polypeptide sequences of Table A3.

| | 1 | 2 | 3 | 4 | 5 | 6 | 7 | 8 | 9 | 10 | 11 | 12 | 13 | 14 | 15 | 16 | 17 | 18 |
|---|---|---|---|---|---|---|---|---|---|---|---|---|---|---|---|---|---|---|
| 1. Sacof__DuS1L | | 65 | 64 | 63 | 64 | 64 | 85 | 52 | 54 | 65 | 96 | 63 | 53 | 65 | 92 | 42 | 32 | 44 |
| 2. A. thaliana__AT5G67220.1 | 77 | | 83 | 85 | 68 | 68 | 64 | 52 | 52 | 68 | 65 | 67 | 51 | 70 | 65 | 38 | 28 | 40 |
| 3. B. napus__BN06MC20455__46646511@20387 | 77 | 88 | | 83 | 70 | 68 | 63 | 56 | 51 | 65 | 64 | 64 | 55 | 65 | 64 | 41 | 31 | 43 |
| 4. B. napus__TC79818 | 77 | 93 | 87 | | 67 | 67 | 63 | 52 | 52 | 66 | 63 | 66 | 51 | 66 | 65 | 38 | 28 | 39 |
| 5. G. max__Glyma 05g20510.1 | 77 | 79 | 80 | 78 | | 94 | 64 | 54 | 53 | 68 | 65 | 63 | 55 | 69 | 65 | 40 | 31 | 43 |
| 6. G. max__Glyma 17g18490.1 | 75 | 78 | 79 | 78 | 96 | | 65 | 54 | 53 | 69 | 65 | 64 | 55 | 69 | 66 | 41 | 31 | 43 |
| 7. O. sativa__LOC__Os06g49870.1 | 92 | 78 | 75 | 77 | 75 | 75 | | 53 | 52 | 66 | 84 | 63 | 52 | 64 | 83 | 42 | 32 | 45 |
| 8. P. patens__149014 | 68 | 68 | 72 | 69 | 70 | 69 | 69 | | 50 | 52 | 52 | 51 | 58 | 51 | 52 | 44 | 35 | 46 |
| 9. P. taeda__TA13257__3352 | 67 | 66 | 62 | 66 | 64 | 62 | 67 | 65 | | 54 | 55 | 52 | 51 | 54 | 53 | 36 | 28 | 40 |
| 10. R. communis__TA2745__3988 | 80 | 80 | 75 | 79 | 80 | 78 | 80 | 69 | 67 | | 65 | 68 | 52 | 72 | 65 | 41 | 30 | 42 |
| 11. S. bicolor__Sb10g029830.1 | 98 | 79 | 77 | 78 | 76 | 75 | 92 | 69 | 68 | 80 | | 64 | 53 | 65 | 94 | 42 | 32 | 45 |
| 12. S. lycopersicum__TC206234 | 78 | 79 | 75 | 78 | 77 | 75 | 76 | 69 | 68 | 81 | 78 | | 51 | 70 | 64 | 39 | 30 | 40 |
| 13. S. moellendorffii__443602 | 69 | 68 | 72 | 68 | 69 | 69 | 68 | 73 | 63 | 68 | 69 | 66 | | 51 | 53 | 44 | 32 | 45 |
| 14. V. vinifera__GSVIVT00019548001 | 81 | 83 | 78 | 81 | 82 | 81 | 80 | 71 | 64 | 84 | 79 | 79 | 68 | | 65 | 40 | 30 | 41 |
| 15. Z. mays__ZM07MC04636__BFb0070D07@4625 | 95 | 79 | 76 | 78 | 77 | 76 | 90 | 69 | 67 | 78 | 95 | 79 | 69 | 81 | | 42 | 31 | 44 |
| 16. C. vulgaris__36290 | 60 | 56 | 61 | 57 | 58 | 59 | 58 | 62 | 51 | 56 | 60 | 57 | 63 | 57 | 60 | | 38 | 48 |
| 17. E. huxleyi__437158 | 49 | 48 | 49 | 47 | 48 | 48 | 50 | 53 | 41 | 47 | 49 | 47 | 50 | 48 | 50 | 53 | | 33 |
| 18. V. carteri__80128 | 61 | 58 | 58 | 59 | 59 | 60 | 61 | 60 | 54 | 59 | 62 | 58 | 59 | 61 | 62 | 60 | 49 | |

The percentage amino acid identity can be significantly increased if the most conserved region of the polypeptides is compared. For example, when comparing the amino acid sequence of a tRNA-dihydrouridine synthase domain as represented by SEQ ID NO: 294 with the respective corresponding domains of the polypeptides of Table A3, the percentage amino acid identity increases significantly (in order of preference at least 50%, 55%, 60%, 65%, 70%, 75%, 80%, 85%, 90%, 95%, 98%, 99% or more amino acid sequence identity).

3.4. ES43-Like Polypeptides

Global percentages of similarity and identity between full length polypeptide sequences useful in performing the methods of the invention is determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison are:
Scoring matrix: Blosum62
First Gap: 12
Extending gap: 2

3.5. HON5-Like Polypeptides

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table C3 for the global similarity and identity over the full length of the polypeptide sequences of Table A5.

TABLE C3

MatGAT results for global similarity and identity over the full length of the polypeptide sequences.

| | 1 | 2 | 3 | 4 | 5 | 6 | 7 | 8 | 9 | 10 | 11 | 12 |
|---|---|---|---|---|---|---|---|---|---|---|---|---|
| 1. HMGA905__Populus | | 35.9 | 31.0 | 31.8 | 38.9 | 29.1 | 17.6 | 26.7 | 32.3 | 25.4 | 23.3 | 59.0 |
| 2. Vitvi__hon5\like | 45.2 | | 30.9 | 31.5 | 32.0 | 32.5 | 26.2 | 32.1 | 32.5 | 24.0 | 23.0 | 32.0 |
| 3. Arath__Hon4 | 47.1 | 40.4 | | 61.3 | 29.1 | 27.8 | 19.2 | 23.3 | 51.6 | 23.9 | 22.6 | 27.6 |
| 4. Brana__Hon5\like | 46.3 | 39.2 | 71.4 | | 28.6 | 27.1 | 19.2 | 21.0 | 46.8 | 22.5 | 20.8 | 26.7 |
| 5. Glyma__HON5\like | 53.3 | 41.2 | 44.2 | 45.6 | | 24.4 | 18.3 | 26.0 | 28.8 | 24.2 | 22.5 | 27.1 |
| 6. HMGA10101__Gosar | 36.8 | 44.2 | 35.8 | 33.7 | 33.3 | | 29.3 | 32.0 | 27.9 | 21.9 | 19.8 | 38.4 |
| 7. HMGA14201__Allce | 24.3 | 33.8 | 25.6 | 26.5 | 24.9 | 38.8 | | 30.8 | 18.2 | 18.4 | 17.9 | 24.4 |
| 8. HMGA1701__Lotja | 32.2 | 37.5 | 29.4 | 28.4 | 30.6 | 43.4 | 47.2 | | 24.4 | 17.7 | 18.2 | 33.2 |
| 9. HMGA2__Arath | 50.3 | 43.4 | 65.8 | 63.5 | 44.0 | 37.2 | 25.3 | 30.5 | | 23.2 | 21.9 | 26.2 |
| 10. HMGA2201__Orysa | 37.2 | 32.5 | 39.8 | 38.5 | 36.8 | 31.6 | 24.7 | 23.2 | 39.2 | | 38.2 | 23.7 |
| 11. HMGA2503__Sacof | 38.6 | 30.4 | 39.5 | 38.6 | 35.3 | 27.3 | 22.6 | 23.1 | 37.0 | 49.7 | | 22.5 |
| 12. HMGA906__Populus | 65.1 | 45.3 | 39.6 | 37.1 | 38.3 | 50.1 | 33.9 | 42.3 | 37.4 | 32.3 | 32.8 | |

3.6. glutamate-1-semialdehyde aminotransferase polypeptides (GSA1 polypeptides)

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix.

Parameters used in the comparison were:
Scoring matrix: Blosum62
First Gap: 12
Extending gap: 2

Results of the software analysis are shown in Table C4 for the global similarity and identity over the full length of the polypeptide sequences. Percentage identity is given above the diagonal in bold and percentage similarity is given below the diagonal (normal face).

The percentage identity between the GSA1 polypeptide sequences useful in performing the methods of the invention can be as low as yy % amino acid identity compared to SEQ ID NO: 418.

TABLE C4

MatGAT results for global similarity and identity over the full length of the polypeptide sequences.

| | 1 | 2 | 3 | 4 | 5 | 6 | 7 | 8 | 9 | 10 | 11 | 12 |
|---|---|---|---|---|---|---|---|---|---|---|---|---|
| 1. ===5613 | | 81.8 | 80 | 78 | 81 | 81.4 | 62.2 | 63 | 64.5 | 63.7 | 75.9 | 83.5 |
| 2. A_thaliana_AT3G48730_1 | 91 | | 90.1 | 78.2 | 91.3 | 90.3 | 63.3 | 66.2 | 66.6 | 65.3 | 76.8 | 81.9 |
| 3. A_thaliana_AT5G63570_1 | 89.1 | 95.4 | | 76.4 | 96.6 | 95.1 | 63.5 | 65.6 | 65 | 63.5 | 77 | 81.5 |
| 4. Aquilegia_sp_TC22821 | 89.1 | 88.2 | 86.3 | | 77.1 | 77.1 | 63.5 | 66.3 | 65 | 63.5 | 76.6 | 79.4 |
| 5. B_napus_TC63445 | 90.6 | 96 | 97.9 | 86.7 | | 97 | 63 | 66 | 66.4 | 64.7 | 77.7 | 82.1 |
| 6. B_napus_TC63450 | 90.8 | 96 | 97 | 88 | 98.5 | | 64.1 | 66.1 | 65.5 | 65.1 | 76.6 | 81.7 |
| 7. C_reinhardtii_138524 | 75.6 | 76.9 | 77.2 | 77 | 77 | 78.2 | | 72.4 | 79.6 | 68.4 | 65.8 | 66.7 |
| 8. C_vulgaris_43392 | 77.9 | 80.3 | 78.7 | 80 | 79.5 | 79.7 | 82.5 | | 74.4 | 65.2 | 68.5 | 68.3 |
| 9. Chlorella_37143 | 77.2 | 78.4 | 77.4 | 78.7 | 78.2 | 78.4 | 88.1 | 86.5 | | 67.5 | 68.9 | 67 |
| 10. E_huxleyi_437052 | 78.7 | 80.3 | 80 | 80.2 | 80.5 | 82.3 | 78.6 | 79.7 | | | 64.9 | 65.8 |
| 11. F_arundinacea_TC6452 | 85.8 | 85.8 | 87.6 | 87.1 | 87.1 | 86.5 | 78 | 80.3 | 79.3 | 79.1 | | 77.7 |
| 12. F_vesca_TA11529_57918 | 92.3 | 92.6 | 92 | 89 | 93 | 93.4 | 79.1 | 81 | 80.3 | 82.5 | 88.2 | |
| 13. G_max_Glyma04g00420_1 | 90 | 89.2 | 87.8 | 88.8 | 88.4 | 89 | 76.2 | 79.4 | 75.7 | 80.9 | 86.3 | 89.4 |
| 14. G_max_Glyma06g00510_1 | 89.1 | 88.3 | 86.7 | 88.2 | 88.2 | 88.6 | 76.6 | 79.7 | 77.5 | 82.2 | 85.8 | 89 |
| 15. H_vulgare_TC162130 | 86.4 | 86.7 | 86.5 | 87.6 | 87.1 | 86.5 | 78.5 | 80.8 | 79.5 | 80.6 | 97.3 | 88.4 |
| 16. M_truncatula_CU024868_27_4 | 89.6 | 90.3 | 87.8 | 88.2 | 89 | 89.6 | 76.7 | 79.5 | 77.4 | 81 | 85.8 | 90.7 |
| 17. N_benthamiana_TC14122 | 90.5 | 88.6 | 88.6 | 87.6 | 88.8 | 89.8 | 75.7 | 79.3 | 79 | 79.3 | 86.1 | 89.6 |
| 18. N_tabacum_TC18263 | 89.8 | 90.2 | 88.9 | 89.1 | 89.7 | 90.8 | 74.9 | 78.2 | 77.4 | 77.8 | 85.4 | 90.2 |
| 19. N_tabacum_TC18710 | 89.1 | 89.5 | 88.7 | 88.7 | 89.5 | 90.6 | 74.9 | 78.2 | 77.4 | 78 | 85.4 | 89.5 |
| 20. O_lucimarinus_28523 | 75.6 | 77.3 | 77 | 75.5 | 77 | 76.7 | 83.4 | 80.6 | 81.9 | 80.8 | 77 | 78.2 |
| 21. O_RCC809_53004 | 71.8 | 74.4 | 74.3 | 72.2 | 74 | 74.2 | 81.6 | 77.8 | 81.5 | 78.6 | 73.8 | 75.1 |
| 22. O_sativa_LOC_Os08g41990_1 | 87.3 | 87.2 | 87.7 | 86.8 | 87.4 | 87.7 | 76.4 | 78.9 | 78.9 | 78.5 | 94.8 | 87.7 |
| 23. O_tauri_24711 | 71.4 | 73.7 | 73 | 72.2 | 73.4 | 73.6 | 80.6 | 76.3 | 79.1 | 77.6 | 73.4 | 74.6 |
| 24. P_patens_116325 | 82.3 | 83.1 | 84.3 | 82.5 | 83.9 | 83.5 | 80 | 78.7 | 80.6 | 79.7 | 83.9 | 84.6 |
| 25. P_patens_181992 | 82.1 | 83.5 | 83.7 | 82.9 | 83.5 | 84.2 | 79.2 | 78.8 | 79.2 | 78.4 | 82.5 | 83.1 |
| 26. P_tremuloides_575404 | 95.8 | 87.8 | 85.9 | 85.9 | 87.1 | 87.3 | 73.1 | 75.1 | 75.5 | 76.5 | 83.1 | 89 |
| 27. P_tricornutum_36347 | 71.6 | 75 | 73.8 | 72.2 | 74.2 | 74.6 | 74.7 | 72.4 | 74.6 | 71.2 | 76.9 | 73.4 |
| 28. R_communis_TA2570_3988 | 93.5 | 92 | 91.6 | 90.3 | 92.6 | 92.6 | 76.7 | 79.1 | 77.8 | 81.4 | 87.7 | 93 |
| 29. S_lycopersicum_TC191683 | 89.8 | 89.4 | 88.4 | 87.1 | 88.4 | 89.6 | 74.3 | 76.6 | 76.6 | 76.8 | 84.6 | 88.6 |
| 30. S_moellendorffii_183248 | 82.9 | 84.2 | 84.7 | 84.2 | 84.7 | 85.5 | 80.5 | 81.3 | 80 | 82.4 | 84.7 | 86.3 |
| 31. T_aestivum_TA06MC00384_60074805_384 | 80.4 | 80.3 | 81 | 81.6 | 81.6 | 80.8 | 74.1 | 75.2 | 75.6 | 76.3 | 90.9 | 81 |
| 32. T_pseudonana_575 | 71 | 73.5 | 73 | 71.9 | 73.4 | 73.6 | 73.4 | 72.6 | 74.3 | 71.4 | 72.7 | 72.9 |
| 33. V_carteri_74470 | 76.2 | 78.8 | 77.2 | 77.6 | 78 | 78.4 | 97 | 84.6 | 88.4 | 81.7 | 78.6 | 79.9 |
| 34. V_shuttleworthii_TA2337_246827 | 92.1 | 92.2 | 90.9 | 90.7 | 91.5 | 91.8 | 78.6 | 79.9 | 80.1 | 82 | 88.8 | 93.4 |
| 35. Z_mays_ZM07MC17771_BFb0062K01_17727 | 87.1 | 87.3 | 86.7 | 87.8 | 87.3 | 87.6 | 77 | 79.1 | 78.9 | 78.7 | 94.1 | 88.2 |

| | 13 | 14 | 15 | 16 | 17 | 18 | 19 | 20 | 21 | 22 | 23 | 24 |
|---|---|---|---|---|---|---|---|---|---|---|---|---|
| 1. ===5613 | 80.1 | 79.8 | 75.6 | 78.3 | 79.4 | 82.1 | 81.7 | 62.4 | 60.8 | 75.2 | 58.9 | 70 |
| 2. A_thaliana_AT3G48730_1 | 78.7 | 78.7 | 77.2 | 80 | 82.1 | 82.9 | 83.1 | 65.1 | 62.9 | 76.4 | 59.5 | 70.3 |
| 3. A_thaliana_AT5G63570_1 | 77.3 | 77.1 | 76.6 | 76.7 | 79.8 | 80.8 | 81 | 63.7 | 62.7 | 75.5 | 59.5 | 70.1 |
| 4. Aquilegia_sp_TC22821 | 76.8 | 76.5 | 77 | 74.9 | 77.5 | 80 | 79.6 | 62.9 | 61.2 | 75.4 | 58.5 | 69.4 |
| 5. B_napus_TC63445 | 77.7 | 77.9 | 77.2 | 78.7 | 80.8 | 81.6 | 82 | 63.7 | 62.8 | 76.5 | 59.5 | 70.1 |
| 6. B_napus_TC63450 | 77.9 | 77.7 | 76.3 | 77.8 | 81.2 | 81.5 | 82.2 | 64.9 | 63.4 | 76 | 60.1 | 69.2 |
| 7. C_reinhardtii_138524 | 63.8 | 63.8 | 66.1 | 63.5 | 63.5 | 61.2 | 60.7 | 73.9 | 71.9 | 63.8 | 71 | 66.6 |
| 8. C_vulgaris_43392 | 65.2 | 65.7 | 68.2 | 65.7 | 66.2 | 64.7 | 64.7 | 67.8 | 66.2 | 66.7 | 65.1 | 66.8 |
| 9. Chlorella_37143 | 64.1 | 64.9 | 68.1 | 65 | 67.8 | 64.9 | 64.6 | 73 | 72.8 | 66.5 | 69 | 67.9 |
| 10. E_huxleyi_437052 | 65.5 | 66.2 | 65.7 | 65.5 | 65.1 | 61.3 | 61.3 | 68.7 | 66.9 | 64.4 | 64.7 | 67.8 |
| 11. F_arundinacea_TC6452 | 77.9 | 77.5 | 95.6 | 76.1 | 77.2 | 76.6 | 77.2 | 65.5 | 62.8 | 91.6 | 62.2 | 73.7 |
| 12. F_vesca_TA11529_57918 | 80.7 | 80.4 | 78.2 | 79.1 | 81.5 | 82.7 | 82.5 | 65.2 | 63.4 | 76 | 61.3 | 73 |
| 13. G_max_Glyma04g00420_1 | | 96.4 | 77.6 | 88.5 | 77.3 | 78.5 | 78.9 | 63.7 | 62.1 | 77 | 60.7 | 70.8 |
| 14. G_max_Glyma06g00510_1 | 98.1 | | 78.2 | 89.4 | 77.7 | 77.3 | 78.3 | 64.4 | 62.7 | 76.6 | 61.9 | 70.5 |
| 15. H_vulgare_TC162130 | 87.7 | 86.4 | | 76.5 | 78 | 77.4 | 77.6 | 65.3 | 63.5 | 90.4 | 61.9 | 73.1 |
| 16. M_truncatula_CU024868_27_4 | 93.2 | 93.8 | 87.4 | | 78.1 | 78.3 | 78.3 | 63.6 | 62.2 | 75.4 | 61.5 | 69.2 |
| 17. N_benthamiana_TC14122 | 87.1 | 86.7 | 86.3 | 87.8 | | 86.1 | 86.3 | 63.5 | 61.4 | 76.3 | 59.5 | 71.6 |
| 18. N_tabacum_TC18263 | 88.3 | 87.2 | 86.2 | 88.3 | 92.1 | | 97.9 | 62.2 | 61.1 | 77 | 57.7 | 69.2 |
| 19. N_tabacum_TC18710 | 88.1 | 87.2 | 86 | 88.3 | 92.3 | 99.2 | | 62 | 61.1 | 76.9 | 57.7 | 69.3 |

TABLE C4-continued

MatGAT results for global similarity and identity over the full length of the polypeptide sequences.

| | | | | | | | | | | | |
|---|---|---|---|---|---|---|---|---|---|---|---|
| 20. O_lucimarinus_28523 | 76 | 76.5 | 77 | 77.4 | 75.5 | 75.3 | 75.3 | | 85.3 | 64.2 | 82.5 | 64.3 |
| 21. O_RCC809_53004 | 73.2 | 74 | 74.6 | 74.1 | 72.4 | 73 | 73 | 87.4 | | 61.5 | 79.7 | 63.9 |
| 22. O_sativa_LOC_Os08g41990_1 | 86.8 | 85.8 | 93.9 | 85.8 | 87.6 | 87 | 86.6 | 75.9 | 73 | | 60.7 | 73.2 |
| 23. O_taurii_24711 | 72.3 | 73.2 | 73.8 | 74.6 | 71.6 | 71.3 | 71.3 | 86.6 | 88.1 | 73 | | 62.6 |
| 24. P_patens_116325 | 82.3 | 82.3 | 84.1 | 82.3 | 84.2 | 81.8 | 82.7 | 77.7 | 76.6 | 85 | 75.2 | |
| 25. P_patens_181992 | 82.9 | 82.1 | 82.9 | 83 | 84 | 81.7 | 82.1 | 76.5 | 75.1 | 83.3 | 73.3 | 95.7 |
| 26. P_tremuloides_575404 | 86.7 | 85.9 | 84.1 | 86.3 | 87.8 | 86.9 | 86.3 | 73.3 | 69.7 | 85.3 | 69.7 | 80.1 |
| 27. P_tricornutum_36347 | 72.3 | 73.2 | 73.6 | 73.3 | 72.4 | 72.8 | 72.8 | 73.3 | 79.1 | 72.6 | 73.1 | 72.9 |
| 28. R_communis_TA2570_3988 | 91.1 | 90.7 | 88.6 | 91.8 | 90.2 | 89.7 | 89.3 | 77.4 | 73.4 | 88.5 | 73.4 | 83.5 |
| 29. S_lycopersicum_TC191683 | 86.5 | 85.9 | 84.2 | 86.7 | 91.9 | 95.9 | 95.9 | 74.1 | 72 | 85.1 | 70.3 | 81.5 |
| 30. S_moellendorffii_183248 | 82.8 | 82.8 | 84.9 | 83.6 | 84 | 84.3 | 84.1 | 77.5 | 75.2 | 83.9 | 73.3 | 86.8 |
| 31. T_aestivum_TA06MC00384_60074805_384 | 81.5 | 81.8 | 91.7 | 81.6 | 80.7 | 79.3 | 79.1 | 71.9 | 70.5 | 87.9 | 69.9 | 78.5 |
| 32. T_pseudonana_575 | 71.5 | 72.7 | 73.1 | 72.6 | 73 | 72.6 | 72.4 | 73.1 | 79.8 | 71.3 | 73.5 | 72.7 |
| 33. V_carteri_74470 | 76.8 | 76.6 | 78.9 | 77.4 | 76.6 | 76.4 | 76.4 | 84 | | 82.1 | 77.6 | 81.3 | 80 |
| 34. V_shuttleworthii_TA2337_246827 | 89.6 | 89.6 | 88.4 | 92 | 90.9 | 91.2 | 90.8 | 78.6 | 74.2 | 88.5 | 74 | 83.9 |
| 35. Z_mays_ZM07MC17771_BFb0062K01_17727 | 87.6 | 86.5 | 94.5 | 86.5 | 86.7 | 86.6 | 86.6 | 76.6 | 73.6 | 95.8 | 73.6 | 85 |

| | 25 | 26 | 27 | 28 | 29 | 30 | 31 | 32 | 33 | 34 | 35 |
|---|---|---|---|---|---|---|---|---|---|---|---|
| 1. ===5613 | 69 | 95.6 | 58.2 | 86.3 | 81.4 | 71.4 | 70 | 57.4 | 64.9 | 82.1 | 76.6 |
| 2. A_thaliana_AT3G48730_1 | 69.1 | 79.3 | 62.3 | 83.4 | 80.9 | 74.1 | 70 | 59.3 | 64.8 | 80.9 | 77.8 |
| 3. A_thaliana_AT5G63570_1 | 68.9 | 77.5 | 61 | 81 | 80.5 | 72.7 | 70.4 | 58 | 64.3 | 81.6 | 77 |
| 4. Aquilegia_sp_TC22821 | 68.2 | 75.6 | 58.9 | 80.9 | 78.4 | 72.2 | 70.9 | 57.4 | 65.2 | 80.4 | 76.9 |
| 5. B_napus_TC63445 | 68.9 | 78.1 | 61.7 | 81.8 | 80.7 | 72.5 | 70.9 | 58.8 | 64.1 | 82 | 78.3 |
| 6. B_napus_TC63450 | 68.6 | 78.7 | 61.7 | 81.8 | 81.2 | 73.7 | 70.3 | 58.4 | 64.9 | 81.8 | 77.8 |
| 7. C_reinhardtii_138524 | 66.3 | 60.6 | 60.9 | 63.4 | 61 | 67.2 | 60.8 | 61.3 | 92.5 | 63.8 | 63.8 |
| 8. C_vulgaris_43392 | 67.1 | 61.6 | 59.8 | 66.6 | 64 | 68.3 | 62.7 | 59.2 | 72.8 | 66.5 | 66.5 |
| 9. Chlorella_37143 | 66.3 | 63.5 | 61.7 | 66.4 | 65.1 | 66.6 | 63.1 | 62.3 | 80.7 | 64.5 | 66.7 |
| 10. E_huxleyi_437052 | 65.9 | 62 | 65.4 | 66.4 | 61.4 | 68.3 | 61.2 | 67.5 | 67.9 | 65.4 | 64.3 |
| 11. F_arundinacea_TC6452 | 72.8 | 73.9 | 62.2 | 78.6 | 76.8 | 76 | 87.9 | 59 | 66 | 77.9 | 89.9 |
| 12. F_vesca_TA11529_57918 | 70.3 | 80.7 | 61.3 | 84.5 | 80.3 | 73.7 | 71.3 | 60 | 67.2 | 84.7 | 78.3 |
| 13. G_max_Glyma04g00420_1 | 70.1 | 77.6 | 59.6 | 82.1 | 77.1 | 72.6 | 71.8 | 57.4 | 64.8 | 81.7 | 78.6 |
| 14. G_max_Glyma06g00510_1 | 69.7 | 77.3 | 60.5 | 80.8 | 76.7 | 72.1 | 71.6 | 58.2 | 64.9 | 81.4 | 78.4 |
| 15. H_vulgare_TC162130 | 72 | 73.3 | 62 | 78.9 | 76.1 | 76.4 | 88.8 | 59.7 | 66.7 | 77.7 | 90.5 |
| 16. M_truncatula_CU024868_27_4 | 69 | 76.3 | 61.1 | 81.7 | 77.1 | 72.5 | 70 | 59 | 64.5 | 82 | 76.7 |
| 17. N_benthamiana_TC14122 | 70.4 | 78.1 | 61 | 80.9 | 85.5 | 72.9 | 71.8 | 58.7 | 64.9 | 81.7 | 77 |
| 18. N_tabacum_TC18263 | 68.2 | 79.7 | 59.6 | 82.3 | 92.9 | 73.9 | 70.5 | 57.7 | 63.2 | 82.5 | 77.4 |
| 19. N_tabacum_TC18710 | 68.2 | 79.3 | 60 | 81.9 | 93.4 | 74.1 | 70.3 | 57.1 | 63 | 82.3 | 77.3 |
| 20. O_lucimarinus_28523 | 62.1 | 60.8 | 60.6 | 63.9 | 61.7 | 65.8 | 60.2 | 61.6 | 74.2 | 64.5 | 64.8 |
| 21. O_RCC809_53004 | 61.9 | 59 | 65.7 | 61.7 | 61 | 64.3 | 57.6 | 66.4 | 72.2 | 62.4 | 61.6 |
| 22. O_sativa_LOC_Os08g41990_1 | 73 | 73.7 | 61.3 | 77.6 | 75.8 | 74.6 | 83.3 | 58.2 | 64.8 | 76.2 | 92.1 |
| 23. O_taurii_24711 | 60.3 | 57.6 | 55.9 | 60.1 | 57.6 | 60.7 | 56.9 | 57 | 71 | 61.1 | 61.1 |
| 24. P_patens_116325 | 89.1 | 68.7 | 60.8 | 71.7 | 69.4 | 76.6 | 68 | 60.5 | 66.8 | 71.9 | 73.3 |
| 25. P_patens_181992 | | 68.1 | 57.8 | 69.1 | 68.6 | 73.7 | 67.2 | 58.8 | 65.4 | 70.1 | 72.7 |
| 26. P_tremuloides_575404 | 81.1 | | 56.4 | 83.8 | 80.1 | 69.9 | 68.1 | 55.6 | 63.3 | 79.4 | 74.3 |
| 27. P_tricornutum_36347 | 70.8 | 69.3 | | 59.6 | 58.9 | 62.2 | 57 | 83.7 | 61.4 | 59.8 | 61.8 |
| 28. R_communis_TA2570_3988 | 82.1 | 90.2 | 72.9 | | 81.2 | 72.8 | 72.9 | 57.9 | 64.4 | 85 | 78.6 |
| 29. S_lycopersicum_TC191683 | 81.7 | 87.8 | 71.4 | 88.8 | | 73.1 | 69.5 | 56.6 | 62.4 | 81 | 76.1 |
| 30. S_moellendorffii_183248 | 85.8 | 79.7 | 74.4 | 84.2 | 83.2 | | 70.5 | 60.9 | 67 | 72.9 | 74.5 |
| 31. T_aestivum_TA06MC00384_60074805_384 | 76.3 | 78.5 | 70.5 | 82.2 | 78.2 | 79.2 | | 55.3 | 61.4 | 71.6 | 82.5 |
| 32. T_pseudonana_575 | 71 | 68.7 | 92.7 | 72.7 | 71.4 | 73.3 | 69.9 | | 61.4 | 58.4 | 57.8 |
| 33. V_carteri_74470 | 79 | 74.1 | 74.8 | 78 | 75.7 | 80.9 | 74.6 | 73.3 | | 65.5 | 65.3 |
| 34. V_shuttleworthii_TA2337_246827 | 84.4 | 89 | 74.2 | 93.9 | 90 | 85.7 | 82.2 | 73.8 | 79.7 | | 77.9 |
| 35. Z_mays_ZM07MC17771_BFb0062K01_17727 | 83.3 | 84.5 | 73.4 | 89.5 | 84.2 | 84.5 | 87.6 | 71.9 | 77.4 | 89.9 | |

A MATGAT table for local alignment of a specific domain, or data on % identity/similarity between specific domains may also be performed.

Example 4

Identification of Domains Comprised in Polypeptide Sequences Useful in Performing the Methods of the Invention 4.1. BET1-Like Polypeptides The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 2 are presented in Table D1.

TABLE D1

| Database | Name | Amino acid coordinates on SEQ ID No 2 |
|---|---|---|
| TMHMM | Transmembrane region | 10-32 |

TMHMM was first described by Krogh. J Mol Biol. 2001 Jan 19; 305(3): 567-80

4.2. Calreticulin Polypeptides

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 105 are presented in Table D2.

TABLE D2

InterPro scan results (major accession numbers) of the polypeptide sequence as represented by SEQ ID NO: 2.

| Database | Domain accession number | Name domain | Amino acid coordinates in SEQ ID NO: 2 | E-value |
|---|---|---|---|---|
| InterPro | IPR000886 | Endoplasmic reticulum targeting sequence | | |
| ScanRegExp | PS00014 | ER_TARGET | (406-409] | |
| InterPro | IPR001580 | Calreticulin/calnexin | | |
| BlastProDom | PD001866 | CRTC_NICPL_Q40401; | (141-231] | 1.00E−47 |
| FPrintScan | PR00626 | Calreticulin | (108-126]; (134-150]; (223-236]; (251-273]; (289-308]; (322-342] | 2.9e−55; 2.9e−55; 2.9e−55; 2.9e−55; |
| HMMPanther | PTHR11073 | Calreticulin AND CALNEXIN | (66-409] | 2.9e−233 |
| HMMPfam | PF00262 | Calreticulin | (29-341] | 5.4e−166 |
| ScanRegExp | PS00803 | Calreticulin_1 | (106-121] | 8.00E−05 |
| ScanRegExp | PS00804 | Calreticulin_2 | (138-146] | 8.00E−05 |
| ScanRegExp | PS00805 | Calreticulin_REPEAT | (216-228]; (251-263] | 8.00E−05 |
| InterPro | IPR008985 | Concanavalin A-type lectin/glucanase | A-like | lectin/glucanase |
| superfamily | SSF49899 | Concanavalin lectins/glucanases | (20-234]; (320-358] | 3.8e−80; 0.00015 |
| InterPro | IPR009033 | Calreticulin/calnexin, | P | |
| superfamily | SSF63887 | P-domain of clanexin/calreticulin | T(213-314] | 6.8e−40 |
| InterPro | IPR009169 | Calreticulin | | |
| HMMPIR | PIRSF002356 | Calreticulin | (6-409] | 4.3e−280 |
| HMMPanther | PTHR11073: SF2 | Calreticulin | (66-409] | 2.9e−233 |
| InterPro | IPR010916 | TonB box, conserved site | | |
| ScanRegExp | PS00430 | TONB_DEPENDENT_REC_1 | (1-25] | NA |
| InterPro | IPR013320 | Concanavalin A-type lectin/glucanase subgroup | A-like | |
| Gene3D | G3DSA:2.60.120.200 | no description | (20-239]; (243-368] | 1.4e−66; 5.2e−16 |

When a given domain is present more than one time in the sequence of SEQ ID NO: 105 the amino acid position of the each domain is separated by symbol ";" in the column Amino acid coordinates in SEQ ID NO: 105. Accordingly the e-value for each domain. If only one e-value is indicated it is taken to mean that each of the domains has the same e-value.

4.3. tRNA Dihydrouridine Synthase 1-Like Polypeptides (DUS1L Polypeptides)

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Interpro is hosted at the European Bioinformatics Institute in the United Kingdom.

The results of the InterPro scan of the polypeptide sequence as represented by SEQ ID NO: 259 are presented in Table D3.

TABLE D3

InterPro scan results of the polypeptide sequence as represented by SEQ ID NO: 259

| InterPro accession number and name | Integrated database name | Integrated database accession number | Integrated database accession name |
|---|---|---|---|
| IPR001269 tRNA-dihydrouridine synthase family | PANTHER | PTHR11082 | tRNA-dihydrouridine synthase |
| | PFam | PF01207 | Dus |

TABLE D3-continued

InterPro scan results of the polypeptide sequence as represented by SEQ ID NO: 259

| InterPro accession number and name | Integrated database name | Integrated database accession number | Integrated database accession name |
|---|---|---|---|
| IPR013785 Aldolase-type TIM barrel | GENE3D | G3DSA:3.20.20.70 | No description |
| IPR018517 tRNA-dihydrouridine synthase, conserved site | Prosite | PS01136 | UPF0034 |
| noIPR unintegrated | Panther | PTHR11082:SF5 | tRNA-dihydrouridine synthase 1 |
|  | SUPERFAMILY | SSF51395 | FMN-linked oxidoreductases |

The TIM barrel is a conserved protein fold consisting of eight α-helices and eight parallel β-strands that alternate along the peptide backbone. The structure is named after triosephosphate isomerase, a conserved glycolytic enzyme. TIM barrels are considered α/β protein folds because they include an alternating pattern of α-helices and β-strands in a single domain. In a TIM barrel the helices and strands (usually 8 of each) form a solenoid that curves around to close on itself in a toroid.

4.4. ES43-Like Polypeptides

Pfam is a large collection of multiple sequence alignments and hidden Markov models covering many common protein domains and families. Pfam is hosted at the Sanger Institute server in the United Kingdom. In order to identify putative BAH and PHD domains in an ES43-like polypeptide, the Pfam database was searched using the amino acid sequence of SEQ ID NO: 299.

The results of the pfam scan of the polypeptide sequence as represented by SEQ ID NO: 299 are presented in Table D4.

TABLE D4

Pfam search results (major accession numbers) of the polypeptide sequence as represented by SEQ ID NO: 299.

| Database | Accession number | Accession name | Amino acid coordinates on SEQ ID NO 299 | Evalue | Alignment method |
|---|---|---|---|---|---|
| Pfam | BAH domain | PF01426 | 21-138 | 6.1e-4 | ls |
| Pfam | PHD domain | PF00628 | 142-191 | 5.3e-17 | fs |

4.5. HON5-Like Polypeptides

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 388 are presented in Table D5.

TABLE D5

InterPro scan results (major accession numbers) of the polypeptide sequence as represented by SEQ ID NO: 2.

| Domain | Name | Algorithm/ database | Accession number | Domain name | Location amino acid coordinates | E-value |
|---|---|---|---|---|---|---|
| InterPro IPR000637 | HMG-I and HMG-Y, DNA-binding | SMART | SM00384 | AT_hook | [153-165]T | 0.0029 |
|  |  |  |  |  | [209-221]T | 8.20E+11 |
|  |  |  |  |  | [229-241]T | 0.140000007 |
|  |  |  |  |  | [244-256]T | 0.149999998 |
|  |  |  |  |  | [260-272]T | 0.008099998 |
|  |  |  |  |  | [301-313]T | 0.014000001 |
|  |  |  |  |  | [325-337]T | 0.079000004 |
|  |  |  |  |  | [347-359]T | 0.0019 |
| InterPro IPR005818 | histone H1/H5 | PFAM | PF00538 | Linker_histone | [47-116]T | 5.30E-14 |
| InterPro IPR011991 | Winged helix repressor DNA-binding | GENE3D | G3DSA 1.10.10.10 | Wing_hlx_DNA_bd | [42-127]T | 1.30E+03 |

4.6. glutamate-1-semialdehyde aminotransferase polypeptides (GSA1 polypeptides)

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 418 are presented in Table D6.

TABLE D6

InterPro scan results (major accession numbers) of the polypeptide sequence as represented by SEQ ID NO: 418.

| | | | AA start | AA stop | |
|---|---|---|---|---|---|
| Gene3D | G3DSA:3.40.640.10 | no description | 123 | 371 | 2.7e−74 |
| HMMPanther | PTHR11986:SF5 | glutamate-1-semialdehyde 2,1-aminomutase | 75 | 479 | 7.2e−236 |
| HMMPanther | PTHR11986 | aminotransferase Class III | 75 | 479 | 7.2e−236 |
| superfamily | SSF53383 | PLP-dependent transferases | 53 | 479 | 3.3e−123 |
| HMMPfam | PF00202 | Aminotran_3 | 89 | 388 | 3.5e−71 |
| ScanRegExp | PS00600 | AA_transfer_Class_3 | 288 | 324 | 8.00e−5 |
| HMMTigr | TIGR00713 | hemL: glutamate-1-semialdehyde 2,1-aminomut | 57 | 479 | 1.8e−247 |

Example 5

Topology Prediction of the Polypeptide Sequences Useful in Performing the Methods of the Invention 5.1. BET1-Like Polypeptides TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters is selected, such as organism group (non-plant or plant), cutoff sets (none, predefined set of cutoffs, or user-specified set of cutoffs), and the calculation of prediction of cleavage sites (yes or no).

5.2. Calreticulin Polypeptides

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters are selected, such as organism group (non-plant or plant), cutoff sets (none, predefined set of cutoffs, or user-specified set of cutoffs), and the calculation of prediction of cleavage sites (yes or no).

Many other algorithms can be used to perform such analyses, including:

ChloroP 1.1 hosted on the server of the Technical University of Denmark;

Protein Prowler Subcellular Localisation Predictor version 1.2 hosted on the server of the Institute for Molecular Bioscience, University of Queensland, Brisbane, Australia;

PENCE Proteome Analyst PA-GOSUB 2.5 hosted on the server of the University of Alberta, Edmonton, Alberta, Canada;

TMHMM, hosted on the server of the Technical University of Denmark

PSORT (URL: psort.org)

PLOC (Park and Kanehisa, Bioinformatics, 19, 1656-1663, 2003).

5.3. ES43-Like Polypeptides

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters is selected, such as organism group (non-plant or plant), cutoff sets (none, predefined set of cutoffs, or user-specified set of cutoffs), and the calculation of prediction of cleavage sites (yes or no).

5.4. HON5-Like Polypeptides

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters is selected, such as organism group (non-plant or plant), cutoff sets (none, predefined set of cutoffs, or user-specified set of cutoffs), and the calculation of prediction of cleavage sites (yes or no).

Many other algorithms can be used to perform such analyses, including:
ChloroP 1.1 hosted on the server of the Technical University of Denmark;
Protein Prowler Subcellular Localisation Predictor version 1.2 hosted on the server of the Institute for Molecular Bioscience, University of Queensland, Brisbane, Australia;
PENCE Proteome Analyst PA-GOSUB 2.5 hosted on the server of the University of Alberta, Edmonton, Alberta, Canada;
TMHMM, hosted on the server of the Technical University of Denmark
PSORT (URL: psort.org)
PLOC (Park and Kanehisa, Bioinformatics, 19, 1656-1663, 2003).

5.5. glutamate-1-semialdehyde aminotransferase polypeptides (GSA1 polypeptides)

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters are selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 418 are presented Table D7. The "plant" organism group has been selected, no cutoffs defined, and the predicted length of the transit peptide requested. The subcellular localization of the polypeptide sequence as represented by SEQ ID NO: 418 is predicted to be the chloroplast, no transit peptide is predicted.

TABLE D7

| Name | Len | cTP | mTP | SP | other | Loc | RC | TPlen |
|---|---|---|---|---|---|---|---|---|
| CDS5613 | 479 | 0.880 | 0.257 | 0.050 | 0.031 | C | 2 | 43 |
| cutoff | | 0.000 | 0.000 | 0.000 | 0.000 | | | |

Many other algorithms can be used to perform such analyses, including:
ChloroP 1.1 hosted on the server of the Technical University of Denmark;
Protein Prowler Subcellular Localisation Predictor version 1.2 hosted on the server of the Institute for Molecular Bioscience, University of Queensland, Brisbane, Australia;
PENCE Proteome Analyst PA-GOSUB 2.5 hosted on the server of the University of Alberta, Edmonton, Alberta, Canada;
TMHMM, hosted on the server of the Technical University of Denmark
PSORT (URL: psort.org)
PLOC (Park and Kanehisa, Bioinformatics, 19, 1656-1663, 2003).

Example 6

Subcellular Localisation Prediction of the Polypeptide Sequences Useful in Performing the Methods of the Invention 6.1 tRNA Dihydrouridine Synthase 1-Like Polypeptides (DUS1L Polypeptides)

Experimental methods for protein localization range from immunolocalization to tagging of proteins using green fluorescent protein (GFP) or beta-glucuronidase (GUS). Such methods to identify subcellular compartmentalisation of GRF polypeptides are well known in the art.

Computational prediction of protein localisation from sequence data was performed. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, TMpred, and others.

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 259 are presented Table E1. The "plant" organism group has been selected, and no cutoffs defined. The subcellular localization of the polypeptide sequence as represented by SEQ ID NO: 259 is mitochondria.

TABLE E1

TargetP 1.1 analysis of the polypeptide sequence as represented by SEQ ID NO: 259

| | |
|---|---|
| Length (AA) | 421 |
| Chloroplastic transit peptide | 0.026 |
| Mitochondrial transit peptide | 0.947 |
| Secretory pathway signal peptide | 0.008 |
| Other subcellular targeting | 0.075 |
| Predicted Location | Mitochondria |
| Reliability class | 1 |

Methods for targeting to mitochondria are well known in the art and include the use of mitochondrial transit peptides. Mitochondrial transit peptides which can be used to target any DUS1L polypeptide to a mitochondria, which DUS1L polypeptide is not, in its natural form, normally targeted to a mitochondria, or which DUS1L polypeptide in its natural form is targeted to mitochondria by virtue of a different transit peptide (for example, its natural transit peptide). For example, a nucleic acid sequence encoding a cyanobacterial or diatom DUS1L polypeptide may also be suitable for use in the methods of the invention so long as the polypeptide is targeted to mitochondria.

Example 7

Assay Related to the Polypeptide Sequences Useful in Performing the Methods of the Invention 7.1. tRNA Dihydrouridine Synthase 1-Like Polypeptides (DUS1L Polypeptides)

DUS1L polypeptides useful in the methods of the present invention (at least in their native form) typically, but not necessarily, have tRNA dihydrouridine synthase (DUS) activity. In vivo DUS-complementation assays are typically used, for example in bacteria or in yeast. An *E. coli* strain from which all three DUS genes have been deleted (D3dus), and, consequently, produces tRNA with no detectable dihydrouridine, is commonly used. The dihydrouridine-free strain thus acts as a "zero background" for testing the ability of DUS genes to catalyze dihydrouridine formation in living cells. By introducing into this strain plasmid-borne DUS genes, it is possible to measure reconstituted the tRNA's dihydrouridine content in tRNA purified from this strain (Bishop et al. (2002) supra).

Colorimetric measurement of tRNA dihyrouridine content is also possible, by an adaptation of the method of Jacobson and Hedgcoth ((1970) Anal Biochem 34, 459-469).

Example 8

Cloning of the Nucleic Acid Sequence Used in the Methods of the Invention 8.1. BET1-Like Polypeptides The nucleic acid sequence used in the methods of the invention was amplified by PCR using as template a custom-made *Arabidopsis thaliana* seedlings cDNA library (in pCMV Sport 6.0; Invitrogen, Paisley, UK). PCR was performed using Hifi Taq DNA polymerase in standard conditions, using 200 ng of template in a 50 µl PCR mix.

The primers used were a first oligonucleotide as represented by SEQ ID NO: 101; for the sense orientation and a second oligonucleotide as represented by SEQ ID NO: 102 for the reverse, complementary strand which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pBET1_ike. Plasmid pDONR201 was purchased from Invitrogen, as part of the Gateway® technology.

The entry clone comprising SEQ ID NO: 1 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 103) for constitutive specific expression was located upstream of this Gateway cassette.

Figure 1:
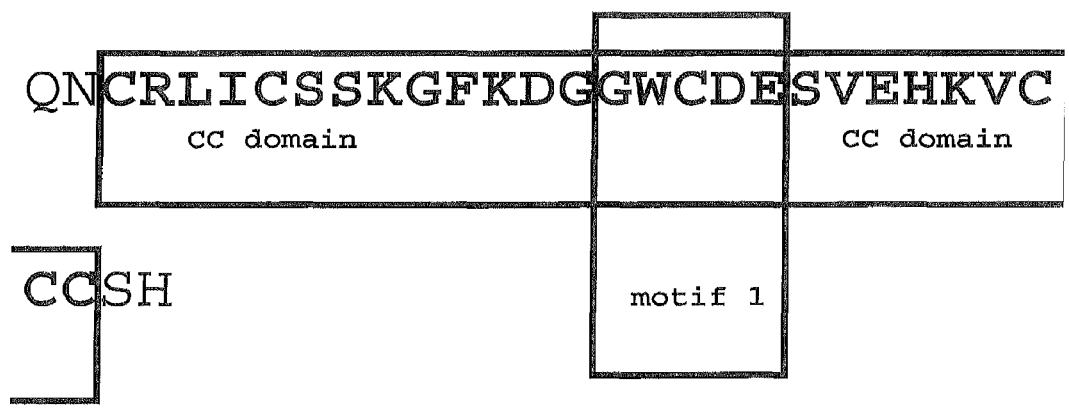
FIG. 1 represents (domain structure, sequence of SEQ ID No: 2 with conserved CC domain (bold) and Motif 1 (underlined) are highlighted.
Figure 3:
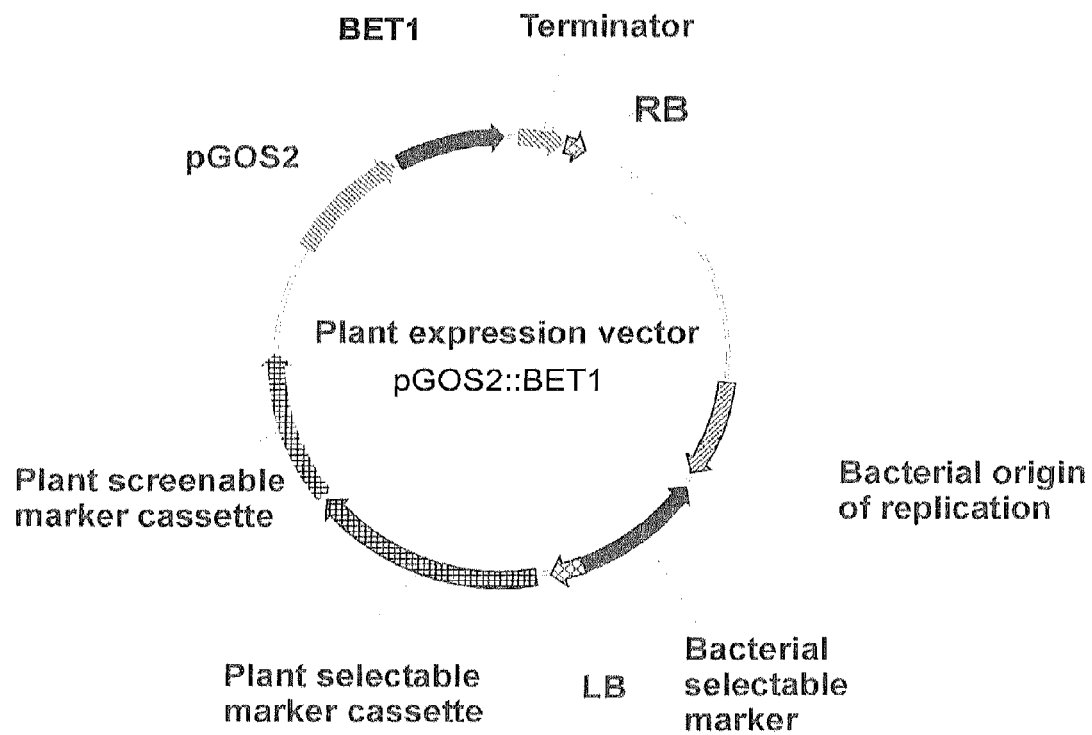
FIG. 3 represents the binary vector used for increased expression in rice of a BET1like-encoding nucleic acid under the control of a rice GOS2 promoter (pGOS2).

After the LR recombination step, the resulting expression vector pGOS2:BET1-like (FIG. 3) was transformed into *Agrobacterium* strain LBA4044 according to methods well known in the art.

8.2. Calreticulin Polypeptides

The nucleic acid sequence used in the methods of the invention was amplified by PCR using as template a custom-made *Lycopersicum esculentum* or *populus trichoparca* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were For S.lycopersicum_TA36564:

```
SEQ ID NO: 253 (sense, start codon in bold):
5'-ggggacaagtttgtacaaaaaagcaggcttaaacaatggctactcgacgaatgaaa-3'
and SEQ ID NO: 254 (reverse, complementary):
5'-ggggaccactttgtacaagaaagctgggttgaatcaaaatgcttggctct-3',
```

For P.trichocarpa_133.107:

```
SEQ ID NO: 255 (sense, start codon in bold):
5'-ggggacaagtttgtacaaaaaagcaggcttaaacaatgggaaaccctaaaactctc-3'
and SEQ ID NO: 256 (reverse, complementary):
5'-ggggaccactttgtacaagaaagctgggtaagagtgcttcctcatcacag-3';
``` which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pCalreticulin. Plasmid pDONR201 was purchased from Invitrogen, as part of the Gateway® technology.

The entry clone comprising SEQ ID NO: 104 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 257) for constitutive specific expression was located upstream of this Gateway cassette.

Figure 6:
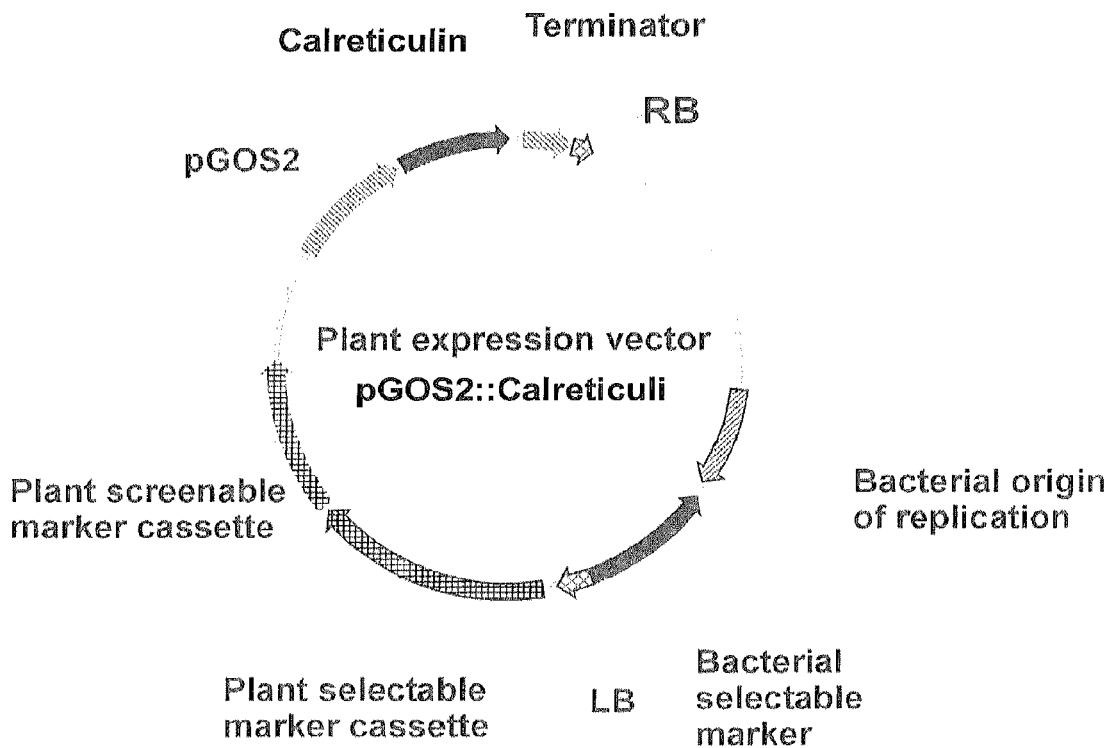
FIG. 6 represents the binary vector used for increased expression in *Oryza sativa* of a Calreticulin-encoding nucleic acid under the control of a rice GOS2 promoter (pGOS2). The term "calreticulin" in this figure is taken to mean any one of the nucleic acid sequences of Table A2, *S.lycopersicum*_TA36564 or *P.trichocarpa*_133.107.
Figure 7:
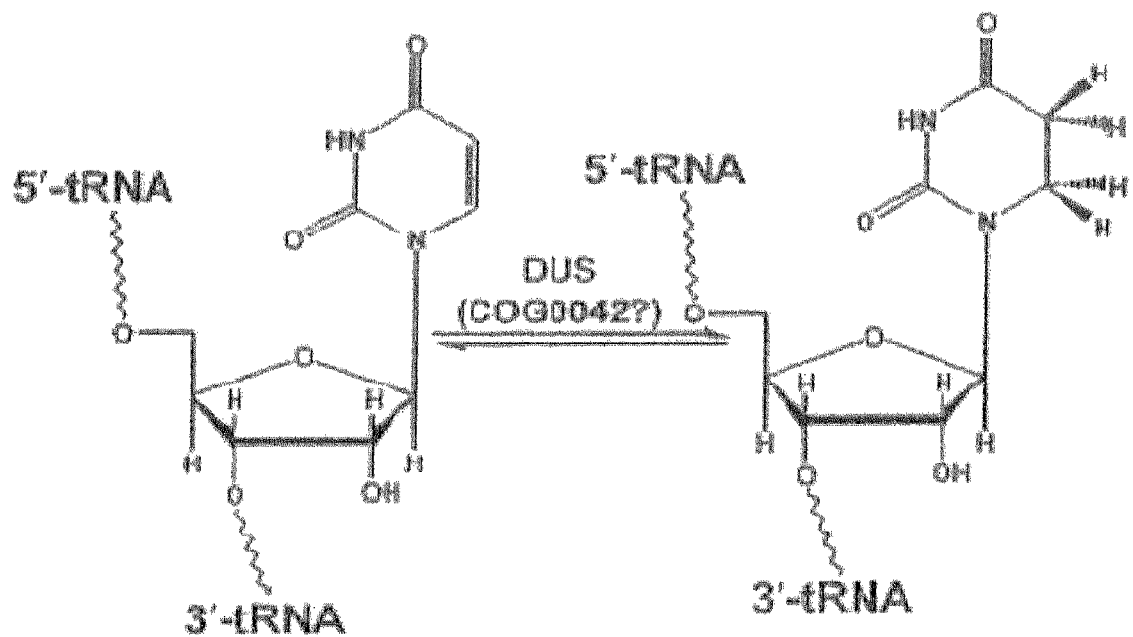
FIG. 7 represents the chemical reaction catalyzed by a DUS enzyme (according to Bishop et al. (2002) J Biol Chem 277(28):25000-25006).
Figure 8:
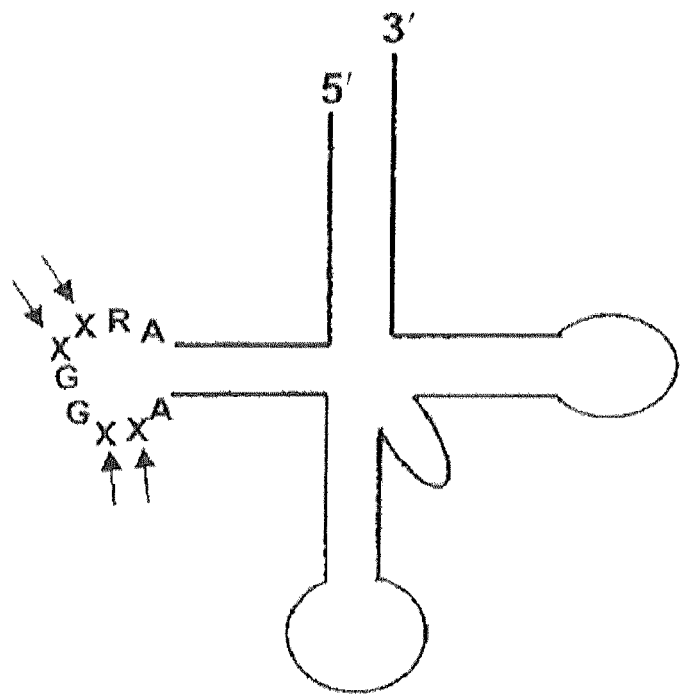
FIG. 8 is a two-dimensional representation of a generic E. coli tRNA with the D-loop nucleotides shown, Conserved D-loop bases are shown (R, purine). Positions that may contain D are shown as X and pointed out with arrows enzyme (according to Bishop et al. (2002) J Biol Chem 277(28): 25000-25006).

After the LR recombination step, the resulting expression vector pGOS2::Calreticulin (FIG. 6) was transformed into *Agrobacterium* strain LBA4044 according to methods well known in the art.

8.3. tRNA Dihydrouridine Synthase 1-Like Polypeptides (DUS1L Polypeptides)

The *Saccharum officinarum* nucleic acid sequence encoding a DUS1L polypeptide sequence as represented by SEQ ID NO: 2 was amplified by PCR using as template a cDNA bank constructed using RNA from tomato plants at different developmental stages. The following primers, which include the AttB sites for Gateway recombination, were used for PCR amplification: prm08359 (SEQ ID NO: 296, sense): 5'-ggggacaagtttgtacaaaaaagcaggcttaaacaatgccactgcgcc-3' and prm08360 (SEQ ID NO: 297, reverse, complementary): 5'-ggggaccactttgtacaagaaagctgggtcctgtcaggcattgc-3'

PCR was performed using Hifi Taq DNA polymerase in standard conditions. A PCR fragment of the expected length (including attB sites) was amplified and purified also using standard methods. The first step of the Gateway procedure, the BP reaction, was then performed, during which the PCR fragment recombined in vivo with the pDONR201 plasmid to produce, according to the Gateway terminology, an "entry clone". Plasmid pDONR201 was purchased from Invitrogen, as part of the Gateway® technology.

The entry clone comprising SEQ ID NO: 258 was subsequently used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 295) for constitutive expression was located upstream of this Gateway cassette.

After the LR recombination step, the resulting expression vector pGOS2::DUS1L (FIG. 10) for constitutive expression, was transformed into *Agrobacterium* strain LBA4044 according to methods well known in the art.

8.4. ES43-Like Polypeptides

The nucleic acid sequence used in the methods of the invention was amplified by PCR using as template a custom-made *Oryza sativa* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were (SEQ ID NO: 384; sense): 5'-ggggacaagtttgtacaaaaaagcaggcttaaacaatggcgaagtcgcgg-3' and (SEQ ID NO: 385; reverse, complementary): 5'-ggggaccactttgtacaagaaagctgggttccaggtgtatctcgtcaatg-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pES43-like. Plasmid pDONR201 was purchased from Invitrogen, as part of the Gateway® technology.

The entry clone comprising SEQ ID NO: 298 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 386) for constitutive specific expression was located upstream of this Gateway cassette.

After the LR recombination step, the resulting expression vector pGOS2::ES43-like (FIG. 13) was transformed into *Agrobacterium* strain LBA4044 according to methods well known in the art.

8.5. HON5-Like Polypeptides

The nucleic acid sequence used in the methods of the invention was amplified by PCR using as template a custom-made *Populus trichocarpa* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were (SEQ ID NO: 414; sense, start codon in bold): 5'-ggggacaagtttgtacaaaaaagcaggcttaaacaatg gacccaccacctcct-3' and (SEQ ID NO: 415; reverse, complementary): 5'-ggggaccactttgtac aagaaagctgggtggaacaaattcatgatcctcg-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pHON5-like. Plasmid pDONR201 was purchased from Invitrogen, as part of the Gateway® technology.

The entry clone comprising SEQ ID NO: 387 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 416) for constitutive specific expression was located upstream of this Gateway cassette.

After the LR recombination step, the resulting expression vector pGOS2::HON5-like (FIG. 15) was transformed into *Agrobacterium* strain LBA4044 according to methods well known in the art.

8.6. glutamate-1-semialdehyde aminotransferase polypeptides (GSA1 polypeptides)

The nucleic acid sequence used in the methods of the invention was amplified by PCR using as template a custom-made *populus* cDNA library (in pCMV Sport 6.0; Invitrogen, Paisley, UK). PCR was performed using Hifi Taq DNA polymerase in standard conditions, using 200 ng of template in a 50 µl PCR mix. The primers used were (SEQ ID NO: 490; sense, start codon in bold): prm(fwd) 5'-ggggacaagtttgtacaaaaaagcaggcttaaacaatggccttctacaa tcacagga-3' and (SEQ ID NO: 491; reverse, complementary): prm(rev) 5'-ggggaccactttgtacaagaaagctgggtcaacaatcacacagcgagata-3' which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pGSA1. Plasmid pDONR201 was purchased from Invitrogen, as part of the Gateway® technology.

The entry clone comprising SEQ ID NO: 417 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 492) for constitutive specific expression was located upstream of this Gateway cassette.

After the LR recombination step, the resulting expression vector pGOS2::GSA1 (FIG. 18) was transformed into *Agrobacterium* strain LBA4044 according to methods well known in the art.

Example 9

Plant Transformation

Rice Transformation

The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent TO rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges1996, Chan et al. 1993, Hiei et al. 1994).

Example 10

Transformation of Other Crops

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MSO) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 μg/ml MgCL2, and with 50 to 100 μg/ml cefotaxime and 400-500 μg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 11

Phenotypic Evaluation Procedure 11.1 Evaluation Setup

Approximately 35 independent TO corn transformants were generated. The primary transformants were transferred from a tissue culture chamber to a greenhouse for growing and harvest of T1 seed. Events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%. Plants grown under non-stress conditions were watered at regular intervals to ensure that water and nutrients were not limiting and to satisfy plant needs to complete growth and development.

In some instances T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

Drought Screen

Plants from T1 seeds were grown in potting soil under normal conditions until they approached the heading stage. They were then transferred to a "dry" section where irrigation was withheld. Humidity probes was inserted in randomly chosen pots to monitor the soil water content (SWC). When SWC went below certain thresholds, the plants were automatically re-watered continuously until a normal level was reached again. The plants were then re-transferred again to normal conditions. The rest of the cultivation (plant maturation, seed harvest) was the same as for plants not grown under abiotic stress conditions. Growth and yield parameters were recorded as detailed for growth under normal conditions.

Reduced Nutrient (Nitrogen) Availability Screen

Plants from six events (T2 seeds) were grown in potting soil under normal conditions except for the nutrient solution. The pots were watered from transplantation to maturation with a specific nutrient solution containing reduced N nitrogen (N) content, usually between 7 to 8 times less. The rest of the cultivation (plant maturation, seed harvest) was the same as for plants not grown under abiotic stress. Growth and yield parameters were recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

11.2 Statistical Analysis: F Test

A two factor ANOVA (analysis of variants) was used as a statistical model for the overall evaluation of plant phenotypic characteristics. An F test was carried out on all the parameters measured of all the plants of all the events transformed with the gene of the present invention. The F test was carried out to check for an effect of the gene over all the transformation events and to verify for an overall effect of the gene, also known as a global gene effect. The threshold for significance for a true global gene effect was set at a 5% probability level for the F test. A significant F test value points to a gene effect, meaning that it is not only the mere presence or position of the gene that is causing the differences in phenotype.

Where two experiments with overlapping events were carried out, a combined analysis was performed. This is useful to check consistency of the effects over the two experiments, and if this is the case, to accumulate evidence from both experiments in order to increase confidence in the conclusion. The method used was a mixed-model approach that takes into account the multilevel structure of the data (i.e. experiment-event-segregants). P values were obtained by comparing likelihood ratio test to chi square distributions.

11.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Early vigour was determined by counting the total number of pixels from aboveground plant parts discriminated from the background. This value was averaged for the pictures taken on the same time point from different angles and was converted to a physical surface value expressed in square mm by calibration. The results described below are for plants three weeks post-germination.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Example 12

Results of the Phenotypic Evaluation of the Transgenic Plants 12.1. BET1-Like Polypeptides The results of the evaluation of transgenic rice plants in the T2 generation and expressing a nucleic acid comprising the longest Open Reading Frame in SEQ ID NO: 1 under non-stress conditions are presented below. See previous Examples for details on the generations of the transgenic plants.

The results of the evaluation of transgenic rice plants under non-stress conditions are presented below. An increase of more than 5% was observed for total seed yield per plant (totalwgseeds), number of filled seeds per plant (nrfilledseed), number of total seeds per plant (nrtotalseed), seed filing rate per plant (fillrate) and harvest index (harvestindex) (Table F1).

TABLE F1

Non-Stress conditions

| Yield related trait | % increase in transgenic compared to control plant |
|---|---|
| totalwgseeds | 19.1 |
| nrtotalseed | 10.3 |
| fillrate | 11.5 |
| harvestindex | 13.3 |
| nrfilledseed | 23.6 |

The results of the evaluation of transgenic rice plants in T1 generation which are expressing a BET1-like nucleic acid according to SEQ ID NO: 1 under drought-stress conditions are presented hereunder. An increase was observed for total aboveground biomass (AreaMax) per plant, number of total seeds per plant (nrtotalseed) and seed filing rate per plat (fillrate) (Table F2).

TABLE F2

Drought Screen

| Yield related trait | % increase in transgenic compared to control plant |
|---|---|
| AreaMax | 6.7 |
| nrtotalseed | 7.7 |
| nrfilledseed | 12.7 |

12.2. Calreticulin Polypeptides

The results of the evaluation of transgenic rice plants transformed with in the T1 generation and expressing a nucleic acid comprising the longest Open Reading Frame in SEQ ID NO: 104 under non-stress conditions are presented below. See previous Examples for details on the generations of the transgenic plants.

An increase of at least 5% was observed for the total seed yield (totalwgseeds), number of filled seeds (nrfilledseed), fill rate (fillrate), number of flowers per panicle (flowerperpan), harvest index (harvestindex), and of the total number of seeds (nrtotalseed) (Table F3).

TABLE F3

| Parameters | Overall |
| --- | --- |
| totalwgseeds | 22.5 |
| nrfilledseed | 17.4 |
| fillrate | 10.6 |
| flowerperpan | 15.4 |
| harvestindex | 20.4 |
| nrtotalseed | 7.9 |

The results of the evaluation of transgenic rice plants transformed with in the T1 generation and expressing a nucleic acid comprising the longest Open Reading Frame in SEQ ID NO: 168 under non-stress conditions are presented below (Table F4). See previous Examples for details on the generations of the transgenic plants.

An increase of at least 5% was observed for the fill rate (fillrate).

TABLE F4

| Parameters | Overall |
| --- | --- |
| fillrate | 11.3 |

12.3. tRNA Dihydrouridine Synthase 1-Like Polypeptides (DUS1L Polypeptides)

The results of the evaluation of T2 generation transgenic rice plants expressing the nucleic acid sequence encoding a DUS1L polypeptide as represented by SEQ ID NO: 259, under the control of a constitutive promoter, and grown under nitrogen limiting conditions, are presented below.

There was a significant increase in aboveground biomass, seed yield per plant, number of filled seeds, and total number of seeds.

TABLE F5

Results of the evaluation of T2 generation transgenic rice plants expressing the nucleic acid sequence encoding a DUS1L polypeptide as represented by SEQ ID NO: 259, under the control of a promoter for constitutive expression.

| Trait | Overall average % increase in 4 events in the T2 generation |
| --- | --- |
| Plant aboveground biomass | 6% |
| Total seed yield per plant | 10% |
| Number of filled seeds | 6% |
| Total number of seeds | 10% |

12.4. ES43-Like Polypeptides

The results of the evaluation of transgenic rice plants in the T2 generation and expressing a nucleic acid comprising the longest Open Reading Frame in SEQ ID NO: 298 under non-stress conditions are presented below. See previous Examples for details on the generations of the transgenic plants (Table F6).

TABLE F6

| Yield trait | % increase in transgenic plants compared to control nullizygous plants |
| --- | --- |
| fillrate (seed filling rate) | 7.0 |

Fillrate was calculated as a proportion (expressed as %) of the number of filled seeds over the number of seeds in the panicles of a plant.

12.5. HON5-Like Polypeptides

The results of the evaluation of transgenic rice plants in the T2 generation and expressing a nucleic acid comprising the longest Open Reading Frame in SEQ ID NO: 387 under non-stress conditions are presented below. See previous Examples for details on the generations of the transgenic plants.

The results of the evaluation of transgenic rice plants under non-stress conditions are presented below (Table F7). An increase of more than 5% was observed for total seed yield (totalwgseeds), number of filled seeds (nrfilledseed), fill rate (fillrate) harvest index (harvestindex), and of at least 2.5 for thousand kernel weight

TABLE F7

| Yield-related trait | % increase in transgenic plant compared to control plant |
| --- | --- |
| totalwgseeds | 10.6 |
| nrfilledseed | 8.9 |
| fillrate | 14.8 |
| harvestindex | 9.3 |

12.6. glutamate-1-semialdehyde aminotransferase polypeptides (GSA1 polypeptides)

The results of the evaluation of transgenic rice plants in the T1 and T2 generations and expressing a nucleic acid comprising the longest Open Reading Frame in SEQ ID NO: 417 under drought stress conditions is presented below.

T1:

| Parameter | Overall |
| --- | --- |
| Total weight seeds | 20.9 |
| Fill rate | 26.3 |
| Harvest index | 22.7 |
| Number filled seed | 22.6 |

T2:

| Parameter | Overall |
| --- | --- |
| Total weight seeds | 59.7 |
| Fill rate | 55.8 |
| Harvest index | 59.9 |
| TKW | 5.7 |
| Number filled seed | 50.6 |
| Flower per pan | 14.5 |
| GravityY Max | 6.4 |
| Root Thick Max | 5.0 |

SEQUENCE LISTING (492 sequences)

SEQ ID NO: 1 - DNA, 258 bp, Zea mays
atggcggtgatgaagagcagcacaatggtcgcccttctattggctgttgccattctgtcctcactgtctccatgctacgaagccggcggctgcatcgggaaacccaagaagtcaccgccgccgccgagaaagccatacttctcgtcctattccgaggaccaccagaactgccgcttgatctgtagctccaagggtttcaaggacggtggctggtgtgacgaaagcgtcgagcacaaagtgtgctgctgctcccattag

SEQ ID NO: 2 - protein, 85 aa, Zea mays
MAVMKSSTMVALLLAVAILSSLSPCYEAGGCIGKPKKSPPPPRKPYFSSYSEDHQNCRLICSSKGFKDGGWCDESVEHKVCCCSH

SEQ ID NO: 3 - DNA, 249 bp, Arabidopsis arenosa_x_thaliana
atgaagctctctttgcgttttctctcagtccttctcctcatctctttcatggttcttgctaccactgcagaggtgagtccggtggataacaaaatatgtaagacacggagtgatcgtttctcaggggtgtgcttgagcactaacaattgtgctatcatctgccaacaattcgagcactttgatggcggtcattgcgaattcgacggagccctccgtcgttgtatgtgcaccaaacaatgtaataattag

SEQ ID NO: 4 - protein, 82 aa, Arabidopsis arenosa_x_thaliana
MKLSLRFLSVLLLISFMVLATTAEVSPVDNKICKTRSDRFSGVCLSTNNCAIICQQFEHFDGGHCEFDGALRRCMCTKQCNN

SEQ ID NO: 5 - DNA, 237 bp, Arachis hypogaea
atggcttctcccatcagtcaaccttattccctaggaattttatgtattttttttattttggcttcaacaggaccattatttgcagatggtacgacactttttcctggcagggtttgtgacgaaccatgccaaggttatggaaattgcgccacaagttgcgttcaaaagggatttcgcggcggtagctgtattggggttattccgagggttatactttgttgttgtttcaagcattaa

SEQ ID NO: 6 - protein, 78 aa, Arachis hypogaea
MASPISQPYSLGILCIFFILASTGPLFADGTTLFPGRVCDEPCQGYGNCATSCVQKGFRGGSCIGVIPRVILCCCFKH

SEQ ID NO: 7 - DNA, 231 bp, Antirrhinum majus
atgggttttaacgctagtagcaaatgtttcgctggaattatatgcctgatttgcatcttgacttcaggacaaacggttgaagccattagggagcctgtggcttgcattggcaattgctcagctttcaagaactgccaaaaagcttgtgttgccaaaggctatcgccgtggtggagcttgtttcggttattcaaaacaaaacctgacttgttgttgtaacagaggttggtag

SEQ ID NO: 8 - protein, 76 aa, Antirrhinum majus
MGFNASSKCFAGIICLICILTSGQTVEAIREPVACIGNCSAFKNCQKACVAKGYRRGGACFGYSKQNLTCCCNRGW

SEQ ID NO: 9 - DNA, 264 bp, Arabidopsis thaliana
atgacaattaagaaatttttacctcttctgctatcttcgttgatggtgtacagtctcatcctcctgcccataatttcaggaaaaagcccagtcagctgtgatggcgcatgcactagcacaccacaatgcaataaaatatgcacatcaaagggttacaaaaaaggaatttgtcacgggagcgctcatttattttacatatgttgttgctacgccaaatttgaatctcaatatgatccttccatttctagtccccctaattactaa

SEQ ID NO: 10 - protein, 87 aa, Arabidopsis thaliana
MTIKKFLPLLLSSLMVYSLILLPIISGKSPVSCDGACTSTPQCNKICTSKGYKKGICHGSAHLFYICCCYAKFESQYDPSISSPPNY

SEQ ID NO: 11 - DNA, 246 bp, Brassica napus
atggaggcttcacgcaaggtgttctcggccatgcttctcatggtgctgctgcttgcagccactggtgagatgggcgggccggtgatggtggcggatgctcgaacgtgcgagtcgcagagccaccggttcaagggcccgtgcgcccgcaaggctaactgcgccatcgtatgcaacacggagggcttccccgacggtgactggcacggcgttctaatcctgtgcatgtgctcgaagccctgctcgtga

SEQ ID NO: 12 - protein, 81 aa, Brassica napus
MEASRKVFSAMLLMVLLLAATGEMGGPVMVADARTCESQSHRFKGPCARKANCAIVCNTEGFPDGDWHGVLILCMCSKPCS

SEQ ID NO: 13 - DNA, 246 bp, Brassica napus
atgacgaccaagaaaatgtcatcccttttattattttcgctgatggtctttatcctcgtatctctacctataatttcaggggatgaatgtacaccgaaggggccatgtgaggacacgaagaaatgcaatatctattgtttattgctgggtttcaaatatggtggattttgtgatacatatgggactacgttttgttgttgcataacatctaaaactcctcctatatccagtcttcctgaacactaa

SEQ ID NO: 14 - protein, 81 aa, Brassica napus
MTTKKMSSLLLFSLMVFILVSLPIISGDECTPKGPCEDTKKCNIYCLLLGFKYGGFCDTYGTTFCCCITSKTPPISSLPEH

SEQ ID NO: 15 - DNA, 225 bp, Betula pendula
atggcaaccaaatcacttgggcttttcttcttcttcctaattatcttcgcttctcaagagatggtgaggccaagtgaggcaagagtttgcgagtcaaagagccacaatttcaagggaccatgcgtgagtgaccaaaactgtggtatggtgtgcagaaatgaaggtttctccgcaggcgattgcaaaggactccgtcgccgttgtttctgcaccagaagttgttaa

SEQ ID NO: 16 - protein, 74 aa, Betula pendula
MATKSLGLFFFFLIIFASQEMVRPSEARVCESKSHNFKGPCVSDQNCGMVCRNEGFSAGDCKGLRRRCFCTRSC

SEQ ID NO: 17 - DNA, 240 bp, Beta vulgaris
aaggcctgttgcaaatacatcttctgcgtgcgccttgacaacttccgtcaggaaatccttcactgttgcaaactgattcacaatttctctttctaacacataatcccctgaacctctggcttggagttccacaagttcttgcttctgcgactcttggcccaatctctgtggccaggacaagcaagagcacaagaaaaattgcggcaaagggcttcattgacagcttcatagttttgcaat

SEQ ID NO: 18 - protein, 79 aa, Beta vulgaris
MKLSMKPFAAIFLVLLLVLATEIGPRVAEARTCGTPSQRFRGLCVRKRNCESVCNSEGFPDGSCQGARRRCICNRPCAK

SEQ ID NO: 19 - DNA, 222 bp, Citrus reticulata_x_temple
atgaagagtttctttgggattttcttgctgctgctcattctattcgcttctcaagagatgatggtgccggcagagggtagggtgtgtcagtcacagagccatcatttccatggcgcatgctttagccaccacaactgtgcttatgtctgcagaaacgaaggcttttctggtggcaaatgccgtggagcccgtcgccgctgcttttgctcaaagctttgctaa

SEQ ID NO: 20 - protein, 73 aa, Citrus reticulata_x_temple
MKSFFGIFLLLLILFASQEMMVPAEGRVCQSQSHHFHGACFSHHNCAYVCRNEGFSGGKCRGARRRCFCSKLC

SEQ ID NO: 21 - DNA, 222 bp, Cyamopsis tetragonoloba
atggcttttcatatctatcaacaatatcttctggtgattttatgcatcgctttgattttggctttcgaagtaacaaatggttatcctctaggagaattaagctgtggaggggattgcataaatattgcaacttgtaaccgtaattgtattctgaatggctttaaaaaagggggtctctgtgttatacaattaaagacttcggtttgttgttgtaagacatga

SEQ ID NO: 22 - protein, 73 aa, Cyamopsis tetragonoloba
MAFHIYQQYLLVILCIALILAFEVTNGYPLGELSCGGDCINIATCNRNCILNGFKKGGLCVIQLKTSVCCCKT

SEQ ID NO: 23 - DNA, 315 bp, Cyamopsis tetragonoloba
gtttcttatagcgaagaattttacaaaaacctcccttgcaaaaaccattatttacacacatgtcattgcaattagcatcatccgatgtatttggaatgcattttggcactaaattgtcatagcaacatttcatgttatttgtttctgcacccatcaatacttggctatccattactgctgcctcaccactcatcatcttcttctcgtatccccactctgtaaacaaaatgatgaggacgatgcagacaagatgtagaagtgttgtaactctactagtcatcatcttctgatttcgttctatgagtaaattagttc

SEQ ID NO: 24 - protein, 104 aa, Cyamopsis tetragonoloba
MMTSRVTTLLHLVCIVLIILFTEWGYEKKMMSGEAAVMDSQVLMGAETNNMKCCYDNLVPKCIPNTSDDANCNDMCVNNGFCKGGFCKILRYKKPSNRYCHCAC

SEQ ID NO: 25 - DNA, 243 bp, Ginkgo biloba
atggcaaagagaatgggcagtctaagcgtttttcttgtggttttggtacttgtgataagcttggagatgcaggcggaggtagcagaggctcggacgtgcaaaactcaaagcagcaagttcaaagggtattgcttgagcgacaccaattgcagaaatgtgtgcagaacagagggatttccgactgggagctgtgatttccatgttgccagccgaaagtgctactgctataaaccctgcgtttga

SEQ ID NO: 26 - protein, 80 aa, Ginkgo biloba
MAKRMGSLSVFLVVLVLVISLEMQAEVAEARTCKTQSSKFKGYCLSDTNCRNVCRTEGFPTGSCDFHVASRKCYCYKPCV

SEQ ID NO: 27 - DNA, 225 bp, Glycine max
atggcttttcatatttatcaacgaccttatgttttgagcgtcatatgcattgctatgattttcgctgcaggagtagtaacttgttttgagtctccactactaagctgccaggagcgatgcatagatgatccaacgtgcgactttatctgccataaaaagggttttgtcaaagggggatcttgtaagccaatcattctatattttctgtgttgctgtatgaaatga

SEQ ID NO: 28 - protein, 74 aa, Glycine max
MAFHIYQRPYVLSVICIAMIFAAGVVTCFESPLLSCQERCIDDPTCDFICHKKGFVKGGSCKPIILYFLCCCMK

SEQ ID NO: 29 - DNA, 255 bp, Lactuca serriola
atggtgaaaatcagcatcaatggcgtcttcctggtcctcctactcctcttggttacatatgaagaagaaagaggtgggagtgggacggtgatgatgatgatggcagaggggaggacctgcgagtcgcagagccatggatttaaagggcggtgcgtcagcaacaataactgtggtctcgtttgcaaaaacgaagggttttccggtgggtggtgtcgtggtcttcgtggaatgtgcttttgcactaaagattgttag

SEQ ID NO: 30 - protein, 84 aa, Lactuca serriola
MVKISINGVFLVLLLLLVTYEEERGGSGTVMMMMAEGRTCESQSHGFKGRCVSNNNCGLVCKNEGFSGGWCRGLRGMCFCTKDC

SEQ ID NO: 31 - DNA, 240 bp, Medicago truncatula
atggctttttcattttatcaatcgtttcttttcttgattttgtgcattgctttggttcttccttcaggattggcaattgggtcagttccagatttccagtgcatagcgccatgcgagggtctcccagaacaatgccctgtattttgtaacaccaggggttttaaaagaggtggcgggtgtcaagttcgaccaaatggaaagaagtgttgttgtcttccaaatcctcctgaattacgatag

SEQ ID NO: 32 - protein, 79 aa, Medicago truncatula
MAFSFYQSFLFLILCIALVLPSGLAIGSVPDFQCIAPCEGLPEQCPVFCNTRGFKRGGGCQVRPNGKKCCCLPNPPELR

SEQ ID NO: 33 - DNA, 186 bp, Medicago truncatula
atggtttttctttcaggatttgcaactagttttggtggtgatcccccgggactaagatgcaggggacaatgcaaagatcctcaacagtgcaatcaattttgcttgaacaatggctttaagaaaggtggtgtttgtcttgcaagtggagccaatcccaattttaagatctgttgttgtcattcttga

SEQ ID NO: 34 - protein, 61 aa, Medicago truncatula
MVFLSGFATSFGGDPPGLRCRGQCKDPQQCNQFCLNNGFKKGGVCLASGANPNFKICCCHS

SEQ ID NO: 35 - DNA, 252 bp, Picea abies
atggcgggcaagggagttggcggtcgactgagcgctctttttctgctcgtgctgctcgtgataagcattgggatgatgcaggttgaagttgcagaggctcgtatgtgcaaaaccccaagcagcaagttcaaaggatattgcgtcagcagcaccaattgcaaaaatgtttgccgaactgaaggatttccaacgggaagctgcgatttccatgtcgccagcagaaagtgctactgctacaagccctgcccttga

SEQ ID NO: 36 - protein, 83 aa, Picea abies
MAGKGVGGRLSALFLLVLLVISIGMMQVEVAEARMCKTPSSKFKGYCVSSTNCKNVCRTEGFPTGSCDFHVASRKCYCYKPCP

SEQ ID NO: 37 - DNA, 243 bp, Picea abies
atggcggccaagggagttggcggtcgactgagcgctctttttctgctcgtgataagcattgggatgatgcaggttgaagttgcagaggctcgtatgtgcaaaaccccaagcagcaagttcaaaggatattgcgtcagcagcaccaattgcaaaaatgtttgccgaactgaaggatttccaacgggaagctgcgatttccatgtcgccagcagaaagtgctactgctacaagccctgcccttga

SEQ ID NO: 38 - protein, 80 aa, Picea abies
MAAKGVGGRLSALFLLVISIGMMQVEVAEARMCKTPSSKFKGYCVSSTNCKNVCRTEGFPTGSCDFHVASRKCYCYKPCP

SEQ ID NO: 39 - DNA, 252 bp, Picea abies
atggcggacaagggagttggcagtcgactgagcgctatttttctgcttgtgctgctcgtcataagcattgggatgatgcagctggagccggcagagggtcgaacctgcaaaaccccaagcggcaaattcaaaggagtttgcgcgagtagcaacaactgcaaaaatgtttgccaaactgagggatttccatcgggaagctgcgatttccatgtggccaacagaaagtgctactgctccaagccctgcccttga

SEQ ID NO: 40 - protein, 83 aa, Picea abies
MADKGVGSRLSAIFLLVLLVISIGMMQLEPAEGRTCKTPSGKFKGVCASSNNCKNVCQTEGFPSGSCDFHVANRKCYCSKPCP

SEQ ID NO: 41 - DNA, 240 bp, Phaseolus coccineus
atgacttctcgcttctgtcatcctttcctcttcaatgttttgttagttgctttggttcttacatcagatctgaatgtagggggaggagcagtagcagaaccagtaacaggaatgatcgatgaagaccttcgatgcttcggtctttgcactggaaattgcaaggaagattgtgcatcaaaggggtttaagagtggtttttgtatccaacaaggatctctcaatcaatgttgttgtctatga

SEQ ID NO: 42 - protein, 79 aa, Phaseolus coccineus
MTSRFCHPFLFNVLLVALVLTSDLNVGGGAVAEPVTGMIDEDLRCFGLCTGNCKEDCASKGFKSGFCIQQGSLNQCCCL

SEQ ID NO: 43 - DNA, 228 bp, Phaseolus coccineus
atggcttttcgcctctgtcattcttttctcttcagtgttttgtttgttgctttggttcttacatcaggaggaggagcagtagcagaaccagtaacaggaatgatcgatgaagaccttcgatgcttcggtctttgcactggaaattgtaaggaagattgtgcatcaaaggggtttaagagtggtttttgtgtccaacaaggatctctaaatcaatgttgttgtctatga

SEQ ID NO: 44 - protein, 75 aa, Phaseolus coccineus
MAFRLCHSFLFSVLFVALVLTSGGGAVAEPVTGMIDEDLRCFGLCTGNCKEDCASKGFKSGFCVQQGSLNQCCCL

SEQ ID NO: 45 - DNA, 228 bp, Phaseolus coccineus
atggcttctcgcttctgtcattcttttctcttcagtgttttgtttgttgctttggttcttacatcaggaggaggagcagtagcagaaccagtaacaggaatgatcgatgaagaccttcgatgcttcggtctttgcactggaaattgtaaggaagattgtgcatcaaaggggtttaagagtggtttttgtgtccaacaaggatctctaaatcaatgttgttgtctatga

SEQ ID NO: 46 - protein, 75 aa, Phaseolus coccineus
MASRFCHSFLFSVLFVALVLTSGGGAVAEPVTGMIDEDLRCFGLCTGNCKEDCASKGFKSGFCVQQGSLNQCCCL

SEQ ID NO: 47 - DNA, 231 bp, Phaseolus coccineus
atgaagatgatcaaaagtttaatcttctttcaaattctttgtattgctgttctcttgacttcaggaacaagcagtgatacaccaatacttcgtcatgaaattgtttgccatgtaggaggaggagcatgtcccgatcctaaagggtgtatgtttttttgtcaaataactggatacaaaaatggtggttattgcattcctcgtggtagtgaaaggtgttgctgcatcctatga

SEQ ID NO: 48 - protein, 76 aa, Phaseolus coccineus
MKMIKSLIFFQILCIAVLLTSGTSSDTPILRHEIVCHVGGGACPDPKGCMFFCQITGYKNGGYCIPRGSERCCCIL

SEQ ID NO: 49 - DNA, 228 bp, Prunus dulcis
atggagaggaaatcttgcattgcgcttgtacttttgctcttcattgtcttggcttcacaagagatggtggtgccaagcgaggcaagggtttgtcagtcacagagccatgggttccgtggaccatgcatccgccaccacaactgtgctctcgtctgcaggaacgaaggcttctccggtggcagatgccgcggctttcgtcgccgttgcttttgcactcgcctctgttga

SEQ ID NO: 50 - protein, 75 aa, Prunus dulcis
MERKSCIALVLLLFIVLASQEMVVPSEARVCQSQSHGFRGPCIRHHNCALVCRNEGFSGGRCRGFRRRCFCTRLC

SEQ ID NO: 51 - DNA, 396 bp, Picea engelmannii_x_glauca
atgcctgggttagatgaatcacgtgggcttccaaagcctgaagaatacgacctgaccacgtttagcacttgcccaccattcttgactacccctgacccgaaactttcgagcgtctggtgtggaagaacagagaggagatcgataatggcggccaagggagttggcggtcgactgagcgctctttttctgctcgtgctgctcgtgataagcattgggatgatgcaggttgaagttgcagaggctcgtatgtgcaaaaccccaagcagcaagttcaaaggatattgcgtcagcagcaccaattgcaaaaatgtttgccgaactgaaggatttccaacgggaagctgcgatttccatgtcgccggcagaaagtgctactgctacaagccctgcccttga

SEQ ID NO: 52 - protein, 131 aa, Picea engelmannii_x_glauca
MPGLDESRGLPKPEEYDLTTFSTCPPFLTTPDPKLSSVWCGRTERRSIMAAKGVGGRLSALFLLVLLVISIGMMQVEVAEARMCKTPSSKFKGYCVSSTNCKNVCRTEGFPTGSCDFHVAGRKCYCYKPCP

SEQ ID NO: 53 - DNA, 261 bp, Pseudotsuga menziesii
atggcgggcaagctgggagttgccagtcgactgagcactctttttctgcttgtgttgcttgtcatgagtatagggatggtgcaggtggaggtggcagaggctcgacagtgcaaaaccgaaagcagcaagttcaaagggtattgcgggagtagcaccaactgcaaaaatgtttgccgaactgagggatttccagctggaagctgtgatttccatgtcgccagcagaaagtgctactgctcgaagccctgccttgatgtgtaa

SEQ ID NO: 54 - protein, 86 aa, Pseudotsuga menziesii
MAGKLGVASRLSTLFLLVLLVMSIGMVQVEVAEARQCKTESSKFKGYCGSSTNCKNVCRTEGFPAGSCDFHVASRKCYCSKPCLDV

SEQ ID NO: 55 - DNA, 252 bp, Pinus pinaster
atggcggccaagggagttggcactcggctcagtgcgctttttctggttgtgctgttcgtcataagcattgggatcatggaggttcaagttgcagagggtcgtatgtgcaaaaccccaagcggcaagttcaaagggtattgcgtcagcagcaccaattgcaaaagtgtttgccgtactgaagggtttccaacgggaagctgcgatttccacgtggcaagcagaaaatgctactgttacaagccctgcccttga

SEQ ID NO: 56 - protein, 83 aa, Pinus pinaster
MAAKGVGTRLSALFLVVLFVISIGIMEVQVAEGRMCKTPSGKFKGYCVSSTNCKSVCRTEGFPTGSCDFHVASRKCYCYKPCP

SEQ ID NO: 57 - DNA, 237 bp, Pinus pinaster
atggccactatgactcgtgttgcgtttgttcttctcttgatatttgtcatcacccttgagttgcaggtggagggcgttgcaggaaaccgaacatgtaaggcgcgtagccacaagtttaagggacactgtgggaaggactccaactgcaaagccatttgtaaaactgagggatttgacgagggcagctgtcaccaccacgtgcacaagaagagatgtttctgcgagaaaccgtgctaa

SEQ ID NO: 58 - protein, 78 aa, Pinus pinaster
MATMTRVAFVLLLIFVITLELQVEGVAGNRTCKARSHKFKGHCGKDSNCKAICKTEGFDEGSCHHHVHKKRCFCEKPC

SEQ ID NO: 59 - protein, 249 aa, Pinus pinaster
ATGGCCACTATGACTCGTGTTGCGTTTGTTCTTCTCTTGATATTTGCCATCACCCTTGAGATACAAGTAGATGGAGAGATGCAGATAGATGGCGTTGCAGAATGTAAAGCGATTAGCCACAAGTTCAAGGGACGCTGCGAGAAGGACGCCAACTGCAAAACCATTTGCAAAACTGAAGGATTTGAGGATGGTAGCTGCCACCACACCCACCTCCTCAAGAAGAAATGTTTATGCAGCAAACACTGCTAA

SEQ ID NO: 60 - protein, 82 aa, Pinus pinaster
MATMTRVAFVLLLIFAITLEIQVDGEMQIDGVAECKAISHKFKGRCEKDANCKTICKTEGFEDGSCHHTHLLKKKCLCSKHC

SEQ ID NO: 61 - DNA, 228 bp, Pinus pinaster
atggccactatgactcgtgttgcgtgtgttcttctcttgatacttgccatcacccttgatggcgttgcaggagaacgacaatgtaaagcgattagccacaagttcaagggacgctgcgagaaggacgccaactgcaaaaccgtttgcaaaactgaaggatttgaggatggcagctgccaccacacccacctcctcaaggagaaatgtttatgcagcaaacactgctaa

SEQ ID NO: 62 - protein, 75 aa, Pinus pinaster
MATMTRVACVLLLILAITLDGVAGERQCKAISHKFKGRCEKDANCKTVCKTEGFEDGSCHHTHLLKEKCLCSKHC

SEQ ID NO: 63 - DNA, 255 bp, Pinus pinaster
atggcgcgcagcggacttcgcactcgattcagcgcgcttttcctgctcgtgctgctcgttatcaccatggggatgatgatggaggttcaagtggcagagggtcgaatgtgcaaaaccccaagcagcaaattcaaagggtactgcgtgagaagtaccaattgcaaaaatatctgccgaacagagggatttccaacgggaagctgtgatttccatgtggccaacagaaaatgctattgctacaagccctgcccttga

SEQ ID NO: 64 - protein, 84 aa, Pinus pinaster
MARSGLRTRFSALFLLVLLVITMGMMMEVQVAEGRMCKTPSSKFKGYCVRSTNCKNICRTEGFPTGSCDFHVANRKCYCYKPCP

SEQ ID NO: 65 - DNA, 252 bp, Picea sitchensis
atggcgggcaagggagttcgcggtcgactgagcgctctttttctgctcgtgcttctcgttataagcattgggatgatgcaggttgaagttgcagaggctcgtatgtgcaaaaccccaagcagcaaattcaaaggatattgcgtcagcagcaccaattgcaaaaatgtttgccgaactgaaggatttccaacgggaagctgcgatttccatgtcgcaagcagaaagtgctactgctacaagccctgcccttga

SEQ ID NO: 66 - protein, 83 aa, Picea sitchensis
MAGKGVRGRLSALFLLVLLVISIGMMQVEVAEARMCKTPSSKFKGYCVSSTNCKNVCRTEGFPTGSCDFHVASRKCYCYKPCP

SEQ ID NO: 67 - DNA, 239 bp, Pinus taeda
gctaccatcctcaaatccttcagttttgcaaatggatttgcagttggcgtccttcccgcagtgtcccttgaacttgtggctaaccgctttacatactcgttctcctgcaacgccatctacctgcatatcaagggctatgacaaatatcaatagaagaacaaacacaacacgagtcatagtggccatcgtcttctcaatatcgctgcttctactgaatatcaataatcgaccacgagatt

SEQ ID NO: 68 - protein, 79 aa, Pinus taeda
MATMTRVVFVLLLIFVIALDMQVDGVAGERVCKAVSHKFKGHCGKDANCKSICKTEGFEDGSCHHTHLLKKKCLCSKHC

SEQ ID NO: 69 - DNA, 252 bp, Pinus taeda
atggcgggcaagggagttggcactcggctgattgctctttttctggttgtgctgctcgtcataagcattgggatgatggaggttcaagttgcagagggtcgtatgtgcaaaaccccaagcggcaagttcaaagggtattgcgtcagcagcaccaattgcgaaaatgtttgccgtactgaaggatttccaacgggaagctgcgatttccacgtggcaagcagaaaatgctactgctacaagccttgcccttga

SEQ ID NO: 70 - protein, 83 aa, Pinus taeda
MAGKGVGTRLIALFLVVLLVISIGMMEVQVAEGRMCKTPSGKFKGYCVSSTNCENVCRTEGFPTGSCDFHVASRKCYCYKPCP

SEQ ID NO: 71 - DNA, 237 bp, Pinus taeda
atggccagtttctctcgtgttgcgttggttcttctcttgatatttgtcattaccattgagttgcaggtggagagcgttgcaggaacgcgaacatgtaaggcgcgtagccacaagtttaagggacactgtgggaagaacgccaactgcaaagccatttgtaaaactgagggatttgaggagggcagctgccaccaccacgtgctgaagaagagatgtttctgtgagaaaccctgctaa

SEQ ID NO: 72 - protein, 78 aa, Pinus taeda
MASFSRVALVLLLIFVITIELQVESVAGTRTCKARSHKFKGHCGKNANCKAICKTEGFEEGSCHHHVLKKRCFCEKPC

SEQ ID NO: 73 - DNA, 254 bp, Pinus taeda
tggcgggtaacggagttggcaatcgactcagcgctcttttcctgctcatgctgttcgttataaccattgggatgatgatggaggttcaagtggcagagggtcgaatgtgcaaaaccccaagcggcaaattcaaaggatattgcgtgagaagcaccaattgtaaaaatatttgccgtactgagggatttccaacgggaagctgcgatttccatgtggccaacagaaaatgctactgctacaaaccctgcccttaa

SEQ ID NO: 74 - protein, 84 aa, Pinus taeda
MAGNGVGNRLSALFLLMLFVITIGMMMEVQVAEGRMCKTPSGKFKGYCVRSTNCKNICRTEGFPTGSCDFHVANRKCYCYKPCP

SEQ ID NO: 75 - DNA, 240 bp, Pinus taeda
aaagccttcagttttgcaaatggatttgcagttggcgtccttctcgcagtgtcccttgaacttgtggctaaccgctttacattctcgttctcctgcaacgccatctaccggcatctcaagggctatgacaaatatcaagagaagaacaaacgcaacacgagtcatagtggccatcgtcttctcaatatcgctgcttctactgaatatcaataatcgatacaacgaactcaaggaaagagg

SEQ ID NO: 76 - protein, 79 aa, Pinus taeda
MATMTRVAFVLLLIFVIALEMPVDGVAGERECKAVSHKFKGHCEKDANCKSICKTEGFEDGSCHHTHHLKKKCLCSKHC

SEQ ID NO: 77 - DNA, 246 bp, Schistosoma indicum
atggagaaaaaaatcgggcagtggagtggtggagccgcgacggcgtgccttgtgttcctgctgttgctcttggcctcccgagagggaataatggtggaggggaggacttgcgagtcgcagagccatgggttcaagggtcggtgcgtcaccagccacaactgcgggctggtgtgcaggaatgagggtttcaccgatggctggtgccgtggcttccgcggccgctgtttctgcaccaggccctgctga

SEQ ID NO: 78 - protein, 81 aa, Schistosoma indicum
MEKKIGQWSGGAATACLVFLLLLLASREGIMVEGRTCESQSHGFKGRCVTSHNCGLVCRNEGFTDGWCRGFRGRCFCTRPC

SEQ ID NO: 79 - DNA, 240 bp, Vaccinium corymbosum
atgtcgcgctccgtgcattgggtttcaactattttccttgtcgtgatgcttctgatggcgagtactgagatgggaggaagggtagcagagggaaggacgtgcgagtcgcagagccagcgtttcaagggaacatgcgcaaggaagagcaactgcgctgctgtttgccagactgaaggctttcagggtggcatctgcaggggcttccgccgtcggtgtttctgcaccaaacactgtgcttag

SEQ ID NO: 80 - protein, 79 aa, Vaccinium corymbosum
MSRSVHWVSTIFLVVMLLMASTEMGGRVAEGRTCESQSQRFKGTCARKSNCAAVCQTEGFQGGICRGFRRRCFCTKHCA

SEQ ID NO: 81 - DNA, 246 bp, Vaccinium corymbosum
atgaggcgctccgtgcattgggtttcagctattttccttgtggtggtgcttctgatggccagtactgagatgggaggaattggggtggcagagggtagaacttgcgagtcacagagccagcgtttcaaaggaccgtgctcaaccgataggaactgcggttccgtttgcgagactgagggctttcaaggtggcaactgcaggggcttccgtcgtcgctgtttctgcagcaaacattgcatggagtaa

SEQ ID NO: 82 - protein, 81 aa, Vaccinium corymbosum
MRRSVHWVSAIFLVVVLLMASTEMGGIGVAEGRTCESQSQRFKGPCSTDRNCGSVCETEGFQGGNCRGFRRRCFCTKHCME

SEQ ID NO: 83 - DNA, 228 bp, Vitis riparia
atggagaggaaatctcttggcatcttcttcttcctcctcctcatcctcttggcttctcaagagatggtggtgccaagcgaggcaagagtctgtgagtcacaaagccataagttcgagggtgcatgcgtgggagaccacaactgtgctctggtctgcaggaatgaaggcttctccggcggcaagtgcaaaggcttccgccgccgatgcttctgcactaagctctgctaa

SEQ ID NO: 84 - protein, 75 aa, Vitis riparia
MERKSLGIFFFLLLILLASQEMVVPSEARVCESQSHKFEGACVGDHNCALVCRNEGFSGGKCKGFRRRCFCTKLC

SEQ ID NO: 85 - DNA, 270 bp, Zea mays
atgatggcactcaacggcggttggagaaagaccttcgtgtccatcctgacgacatgctttcttgtggtggttgtaattgtttccctatcctgcgaagcaaaaggcggcgtcgtccccaggttgcggccaccattctgctttccatacgatcgtgaatactgcacgccatttcactgcggcaaagtttgccaagagtacaacttccctgctaagaatggcggctactgcgataaacgtggtgacccatggaagtgctgctgtccatattga

SEQ ID NO: 86 - protein, 89 aa, Zea mays
MMALNGGWRKTFVSILTTCFLVVVVIVSLSCEAKGGVVPRLRPPFCFPYDREYCTPFHCGKVCQEYNFPAKNGGYCDKRGDPWKCCCPY

SEQ ID NO: 87 - DNA, 270 bp, Zea mays
atggcggtgatgaagagcaggacggtcatcgtcgccgccgttctgttggcggttgtcattctgtcctcactgtgtccatgctacgaagccggcggctgcatcgggaagccgcccaagacgccggcgccgaaaaggccctgcttctcgccctactccgaggaccactgtgaccgccagaactgccgcttcgtctgcatgtcgcacggttacagtgacggtggctggtgtgacgagagggaggtgcgcaaaatgtgctgctgctaccattag

SEQ ID NO: 88 - protein, 89 aa, Zea mays
MAVMKSRTVIVAAVLLAVVILSSLCPCYEAGGCIGKPPKTPAPKRPCFSPYSEDHCDRQNCRFVCMSHGYSDGGWCDEREVRKMCCCYH

SEQ ID NO: 89 - DNA, 270 bp, Zea mays
atggcggtgatgaagagcaggacggtcgtcgtcgccgccgttctgttggcggttgtcattctgtcctcactgtgtccatgctacgaagccggcggctgcatcgggaagccgcccaagacgccggcgccgaaaaggccctgcttctcgccctactccgaggaccactgtgaccgccagaactgccgcttcgtctgcatgtcgcacggttacagtgacggtggctggtgtgacgagagggaggtgcgcaaactgtgctgctgctaccattag

SEQ ID NO: 90 - protein, 89 aa, Zea mays
MAVMKSRTVVVAAVLLAVVILSSLCPCYEAGGCIGKPPKTPAPKRPCFSPYSEDHCDRQNCRFVCMSHGYSDGGWCDEREVRKLCCCYH

SEQ ID NO: 91 - DNA, 258 bp, Zea mays
atggcggtgatgaagagcagcacaatcgtcgcgcttctgttggctgttgccattctgtcctcactgtctccatgctacgaagccggcggctgcatcgggaaacccaagaagtcaccgccgccaccgagaaggccatacttctcgtcctattccgaggaccaccagaactgccgcttgatctgtagctcgaagggtttcaaggacggtggctggtgtgacgaaagcgtggagcacaaagtgtgctgctgctcccattag

SEQ ID NO: 92 - protein, 85 aa, Zea mays
MAVMKSSTIVALLLAVAILSSLSPCYEAGGCIGKPKKSPPPPRRPYFSSYSEDHQNCRLICSSKGFKDGGWCDESVEHKVCCCSH

SEQ ID NO: 93 - DNA, 270 bp, Zea mays
atggcggtgatgaagagcagcacggtcgtcgtcgccgccgttctgttggcggttgtcattctgtcctcgctgtctccatgctacgaagccggcggctgtatcgggaagccgcccaagacgccggcgccgaaaaggccctgcttctcgccctactccgaggaccactgtgaccgccagaactgccgcttcgtctgcatgtcgcacggttacagtgacggtggctggtgtgacgagagggaggtgcgcaaactgtgctgctgctaccattag

SEQ ID NO: 94 - protein, 89 aa, Zea mays
MAVMKSSTVVVAAVLLAVVILSSLSPCYEAGGCIGKPPKTPAPKRPCFSPYSEDHCDRQNCRFVCMSHGYSDGGWCDEREVRKLCCCYH

SEQ ID NO: 95 - DNA, 270 bp, Zea mays
atggcggtgatgaagagcagcacaatcgtcgcgcttctattggctgttgccattctgtcctcactgtctccatgctacgaagccggcggctgcatcgggaaacccaagaagtcaccgccgccgccgagaaggccatacttctcgtcctattccgaggaccaccagaaggaccaccagaattgccgcttgatctgtagctccaagggtttcaaggacggtggctggtgtgacgaaagcgtggagcacaaagtgtgctgctgctcccattag

SEQ ID NO: 96 - protein, 89 aa, Zea mays
MAVMKSSTIVALLLAVAILSSLSPCYEAGGCIGKPKKSPPPPRRPYFSSYSEDHQKDHQNCRLICSSKGFKDGGWCDESVEHKVCCCSH

SEQ ID NO: 97 - protein, 33 aa, Artificial sequence
  CC domain
  UNSURE (2)..(4): Xaa can be any amino acid
  UNSURE (6)..(12): Xaa can be any amino acid
  UNSURE (13)..(14): Xaa can be any amino acid or no amino acid
  UNSURE (16)..(23): Xaa can be any amino acid
  UNSURE (24)..(30): Xaa can be any amino acid or no amino acid
  misc_feature (32)..(32): Xaa can be any naturally occurring amino acid
CXXXCXXXXXXXXXGXXXXXXXXXXXXXXXCXC

SEQ ID NO: 98 - protein, 27 aa, Artificial sequence
  CC domain in SEQ ID NO: 2
CRLICSSKGFKDGGWCDESVEHKVCCC

SEQ ID NO: 99 - protein, 5 aa, Artificial sequence
  motif 1
GWCDE

SEQ ID NO: 100 - protein, 3 aa, Artificial sequence
  motif 2
EGF

SEQ ID NO: 101 - DNA, 58 bp, Artificial sequence
  primer 1
ggggacaagtttgtacaaaaaagcaggcttaaacaatggcggtgatgaagagcagcac

SEQ ID NO: 102 - DNA, 48 bp, Artificial sequence
  primer 2
ggggaccactttgtacaagaaagctgggttctaatgggagcagcagca

SEQ ID NO: 103 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 104 - DNA, 1298 bp, Solanum lycorpersicum
tttgtacaaaaaagcaggctaaaacaatggctactcgacgaatgaaaagccctagctctctccatctcgttgctgtgttctctctactagtagtcgccgccgccgccgaagttttcttccaggaaagcttcaatgatggttgggaaagcaggtgggtaaaatctgaatggaagaaagatgaaaacatggctggagagtggaatcacacctctgggaagtggaatggtgacgccaatgacaaaggtattcagaccagtgaagactacaggttctacgccatttcggctgagttccctgaatttagtaacaagggaaagaacttagtgttccagttctctgttaagcatgagcagaagcttgactgtggtggtgggtacatgaagttgcttagtggagacgttgaccaaaagaaattcggtggtgacactccctacagtatcatgtttggaccagacatctgtggctacagtaccaagaaagtccatgctattctcacttataacgagacaaaccatttgatcaagaaggaagtcccatgtgagactgatcagctgacccatgtctacactttcatcctccgtcctgatgccacatacagtattctcattgacaatgtggagaaacagtctggtagcttgtactctgattgggacattctcccaccaaagaagatcaaggatccaagtgccaagaaacctgaagattgggatgacaaggaattcattgatgatcccgaggataagaagccagagggctatgatgacattccagaggagataactgatcctgaagccaagaagccagaggactgggatgatgaagaagatggtgaatggacagccccaaccatccccaatccagagtacaagggcccatggaaggcaaagaaaatcaagaaccccaactacaagggaaagtggaaggctcctatgattgacaacccagacttcaaggatgacccagatctatatgttttcccaaaattgaagtatgttggagtggagctgtggcaagtgaaatctggaactttgtttgacaatgttgtgatatgcgatgatccagagtttgccaagtcaattgcagaggaaacatggggaaagcagaaagatgctgaaaaggctgcttttgaggaagcagaaaagaagagagaggaggaggaatcaaagaatgctccagctgaatctgatgccgatgaagatgacgaggctgatgacaagtctgactccaaggatgaggacacacatgatgaactgtaagagccaagcattttgattcaacccagctttcttgtacaaagt

SEQ ID NO: 105 - protein, 409 aa, Solanum lycorpersicum
MATRRMKSPSSLHLVAVFSLLVVAAAAEVFFQESFNDGWESRWVKSEWKKDENMAGEWNHTSGKWNGDANDKGIQTSEDYRFYAISAEFPEFSNKGKNLVFQFSVKHEQKLDCGGGYMKLLSGDVDQKKFGGDTPYSIMFGPDICGYSTKKVHAILTYNETNHLIKKEVPCETDQLTHVYTFILRPDATYSILIDNVEKQSGSLYSDWDILPPKKIKDPSAKKPEDWDDKEFIDDPEDKKPEGYDDIPEEITDPEAKKPEDWDDEEDGEWTAPTIPNPEYKGPWKAKKIKNPNYKGKWKAPMIDNPDFKDDPDLYVFPKLKYVGVELWQVKSGTLFDNVVICDDPEFAKSIAEETWGKQKDAEKAAFEEAEKKREEEESKNAPAESDADEDDEADDKSDSKDEDTHDEL

SEQ ID NO: 106 - DNA, 1560 bp, Aquilegia formosa
cagttcagttgagttctcgagtaagaatggcgattcgaagaaaaaaccctagttttcttggtttcattcttctttctgttttcttagttggaattgtttctgctgaagtcttctttgaagaacgattcgaagatggatgggagaaccgttgggtaaaatctgattggaagaaggatgaaaacactgctggagaatggaacttcactgctggtaaatggcatggagatgccaatgataaaggtatccaaaccagtgaggactaccgattttatgctatctctgctggatttcctgagttcagcaacaaggagaagacattggttttccagttctcagttaaacacgagcaaaaacttgattgtggtggtggttacatgaaattgcttagtggtgatgttgatcagaagaagtttggtggtgacacaccctacagtatcatgtttggaccagatatttgtggctacagcactaaaaaggtccatgctattctttcacgtgatggaacaaaccatctgatcaagaaggatgttccatgcgagaccgatcagctaactcatgtgtatacttttgtccttcgaccagatgcttcatatagcatccttattgacaatgtagagaaacaatctggaagtttatattcagactgggatattcttcctccaaagaaaatcaaggatcccgaagctaaaaaaccggaagattgggatgacaaggagtatattcctgaccctgaagatacaaagccagagggttatgatgacatccccgctgagatccctgatgcagatgctaaaaagcctgaagactgggatgatgaggaagatggtgaatgggcagcgccaactattgctaaccctgaatacaagggaccatggaaggcaaagaaaatcaagaaccccaactacaagggaaagtggaaggcaccaatgattgataacccagatttcaaggatgacccagacatttatgtttaccccaagttgaaatatgtgggcattgagctgtggcaggtaaagtcagggaccatgtttgacaatgtcttggtttgtgatgatcctgaatatgcaaagaaactagctgaagaaacctggggcaaacacaaagatgctgagaaggcagcatttgaagaggcagagaaaaagattgaagaggaggaatctaagaatgatcctgctgattctgatgatgagaaggcaggtgatgatgatgatgccgaaggcgaggatgccgatgatgaagaagctaaaggggattcagatgaggatgaagtacatgatgagctttaggcaaagcggacaagtctggcttgaaaattagcatagagaaaagtgtgggttgttaggcactccaaacaaaatttttccagtttttttttcttttggatgtagggattttctctctagaatcaccagtttagattggacaaaatgcttggttattgattataatatcagtctcagttttctttccaagttcaacatgccatgacttgttctgcatgcacttttgaagcaagaaaatgtggagaagtaaataatagacagtaactcttattagaga

SEQ ID NO: 107 - protein, 419 aa, Aquilegia formosa
MAIRRKNPSFLGFILLSVFLVGIVSAEVFFEERFEDGWENRWVKSDWKKDENTAGEWNFTAGKWHGDANDKGIQTSEDYRFYAISAGFPEFSNKEKTLVFQFSVKHEQKLDCGGGYMKLLSGDVDQKKFGGDTPYSIMFGPDICGYSTKKVHAILSRDGTNHLIKKDVPCETDQLTHVYTFVLRPDASYSILIDNVEKQSGSLYSDWDILPPKKIKDPEAKKPEDWDDKEYIPDPEDTKPEGYDDIPAEIPDADAKKPEDWDDEEDGEWAAPTIANPEYKGPWKAKKIKNPNYKGKWKAPMIDNPDFKDDPDIYVYPKLKYVGIELWQVKSGTMFDNVLVCDDPEYAKKLAEETWGKHKDAEKAAFEEAEKKIEEEESKNDPADSDDEKAGDDDDAEGEDADDEEAKGDSDEDEVHDEL

SEQ ID NO: 108 - DNA, 1745 bp, Arabidopsis thaliana
gctagctcctctcctcgcggtatatataagctccaggtcttgtacatcttcatcatctgatctcggggaagctccgatctgagttttttttagcaatggcgaaaatgattcctagcctcgtctctctaattcttatcggtcttgttgcgatcgcctccgccgcagttattttcgaggagcgctttgatgatggctgggagaacagatgggttaaatctgagtggaagaaggatgataacactgctggggagtggaagcacactgcgggaaattggtctggtgacgctaacgataaaggtatccagaccagtgaagactacagattctacgccatttcagctgagttccctgaattcagtaacaaggacaagaccttagtcttccaattctcagtcaagcacgagcaaaagcttgactgcggtggtggctacatgaagctactaagtggtgatgttgaccaaaagaaatttggtggagacacaccatacagtatcatgtttggtcctgatatctgtggctacagcacaaagaaagtgcatgctatccttacctataatgaagccaaccacctgatcaagaaagatgttccatgtgaaactgaccagctcacccatgtgtacacatttatcctccgcccagatgctacttacagcattctcatcgacaatgttgagaaacaaactggtagcctttactctgactgggatcttctcccacccaagaagatcaaggaccccagcgccaagaagcctgaggactgggacgaacaagaatacatttctgaccctgaagacaagaaacctgacggttacgatgatatccctaaggagatcccagacaccgactcaaagaagcctgaggactgggatgatgaagaagatggtgagtggactgccccaacaatccccaaccctgagtacatgggtgaatggaagcctaagcaaatcaagaaccccaactacaagggcaagtgggaggctccattgattgacaaccctgacttcaaggatgacccagagctctacgtcttccccaagctgaaatatgttggactcgaattgtggcaggtgaaatcaggatcattgttcgacaatgtcttgatctgcgatgacccagactatgccaagaagttggcagatgaaacatggggaaagctcaaggatgcggagaaagcagctttcgatgaggctgagaagaagaatgaggaagaggaatccaaggacgcacctgcggaatctgatgctgaagacgaaccagaggatgatgaaggaggagatgattccgattctgaatctaaggccgaggagaccaaatcagtagatagcgaggaaacctctgagaaagacgccaccgctcatgatgagctataggtgaaaggttgaagatttgaagaccaaagttttcagtctctttattgttttatcgttttcttttgaagtattttagcatctagtttgtcggagatagaaacaagttttagcaaaactaaaagggggatacaatgtctgtcagatgctcattttagactttaaaaaaccatgaagaagttttgcagttgcttctctttctctactcttgtttctctgctaagccaatgtccgccaaaatcggattctggtgtattcgttcactgctccccaccctttgagaatttgttgttagtctcttgtcagtcaatacagaccaccaagtccataatccaacagtccaacgtccctgcaagttgattgatactagagtagtag

SEQ ID NO: 109 - protein, 424 aa, Arabidopsis thaliana
MAKMIPSLVSLILIGLVAIASAAVIFEERFDDGWENRWVKSEWKKDDNTAGEWKHTAGNWSGDANDKGIQTSEDYRFYAISAEFPEFSNKDKTLVFQFSVKHEQKLDCGGGYMKLLSGDVDQKKFGGDTPYSIMFGPDICGYSTKKVHAILTYNEANHLIKKDVPCETDQLTHVYTFILRPDATYSILIDNVEKQTGSLYSDWDLLPPKKIKDPSAKKPEDWDEQEYISDPEDKKPDGYDDIPKEIPDTDSKKPEDWDDEEDGEWTAPTIPNPEYMGEWKPKQIKNPNYKGKWEAPLIDNPDFKDDPELYVFPKLKYVGLELWQVKSGSLFDNVLICDDPDYAKKLADETWGKLKDAEKAAFDEAEKKNEEEESKDAPAESDAEDEPEDDEGGDDSDSESKAEETKSVDSEETSEKDATAHDEL

SEQ ID NO: 110 - DNA, 1523 bp, Arabidopsis thaliana
cgtgtgaagctccgatctgagtttttagcaatggcgaaactaaaccctaaattcatctctttgattcttttcgctctcgtggtgatcgtctctgctgaagttatcttcgaggagaaattcgaagatggatgggagaagagatgggtaaaatctgactggaagaaagatgataatactgctggggaatggaaacacacagctggaaattggtctggtgatgctaacgataaaggtatccaaactagcgaggactacagattctacgctatatcagctgaattccctgagtttagcaacaaggataagaccttagtcttccaattctctgtcaagcatgagcagaagcttgactgtggtggtggctacatgaagttgctaagtgatgatgttgaccagacgaaattcggaggagacactccttacagcattatgtttgggccagatatttgtggctacagcactaagaaagtacatgctatccttacttacaatggaaccaaccatttgatcaagaaggaggtcccatgtgagactgatcagcttactcacgtgtacaccttcgtcctccgtccagatgctacttacagtattttgattgataatgttgagaagcaaactggtagcctttactctgactgggatcttctcccagcaaagaagattaaggatccaagtgctaagaagcctgaggactgggatgacaaagagtacattccagatccagaagacactaagccagcgggatatgatgacatcccaaaggagattccagacactgacgcaaagaagcctgaggactgggatgatgaagaagatggtgagtggactgcccctaccattcccaaccccgagtacaatggtgaatggaagcccaagaaaattaagaaccccgcttacaagggcaagtggaaggctccaatgatcgacaaccctgaattcaaggatgacccagaactctatgtcttccccaaattgaagtatgttggagttgagttgtggcaggtgaaatctggttccttgttcgacaatgtcttggtcagcgatgacccagagtacgctaagaagttggccgaggaaacctggggaaagcacaaggatgcggagaaagcagcatttgacgaagctgagaagaagagagaggaagaggaatcaaaggatgctcctgctgaatccgacgctgaggaagaagcagaagatgatgacaatgaaggagatgactcagacaatgaatcaaagtctgaggaaaccaaggaggccgaggaaaccaaggaagccgaggaaaccgatgccgcccatgacgagctctaagcaaaggtggaggattaaaaagttttcagagtcttaattgttcttttaaacttttcttttaaaaggaattctttagctctagtttggttggaatgtagaactttttagctattattatggtgaaatggttgtggtaactttgttttagactttgagaaaatcctgactttctccttctctttaccaattcacaattagtaaaaaggaaataatgg

SEQ ID NO: 111 - protein, 425 aa, Arabidopsis thaliana
MAKLNPKFISLILFALVVIVSAEVIFEEKFEDGWEKRWVKSDWKKDDNTAGEWKHTAGNWSGDANDKGIQTSEDYRFYAISAEFPEFSNKDKTLVFQFSVKHEQKLDCGGGYMKLLSDDVDQTKFGGDTPYSIMFGPDICGYSTKKVHAILTYNGTNHLIKKEVPCETDQLTHVYTFVLRPDATYSILIDNVEKQTGSLYSDWDLLPAKKIKDPSAKKPEDWDDKEYIPDPEDTKPAGYDDIPKEIPDTDAKKPEDWDDEEDGEWTAPTIPNPEYNGEWKPKKIKNPAYKGKWKAPMIDNPEFKDDPELYVFPKLKYVGVELWQVKSGSLFDNVLVSDDPEYAKKLAEETWGKHKDAEKAAFDEAEKKREEEESKDAPAESDAEEEAEDDDNEGDDSDNESKSEETKEAEETKEAEETDAAHDEL

SEQ ID NO: 112 - DNA, 1315 bp, Amborella trichopoda
gtcttttagagctcgagctctgcaacaatggcggggcgttcgcttctctgtctactttcctttctattactgatccaaaatccgcttgcaaaggtcttatttgaagagagatttgatgatggatgggagaagcgatgggtggtttcagactggaagaaagatgaaaacatgtctggacagtggatacacacatctgggaaatggactggagatcctaatgacaagggcatccaaaccagtgaagactacaggttctttgccatctctgcagagtttcctgtgtttagtaacaaggataaaaccttggtttttcaattctctgtgaagcacgagcaaaagcttgactgtggtggggggtacatgaagctcctcagtgatgatgttgatcagaagaagtttggtggtgagacaccttacagcatcatgtttggaccagatatttgtgggtacagcacaaagaaggttcatgctatcctctcacgaaatggaactaaccatttgatcaagaaggaggttccttgcgaaactgaccagcttacccatgcctatactttcatcatccgccctgatgctacatacagcatccttattgacaataatgagaaacaaaccgggagtctttactcagattgggacattctcccacctaagaagatcaaggaccccgaggccaaaaagccagaagattgggatgacaaggagtacatacctgatccagaagataagaagccagagggctatgatgacattcccaaggagatagtggattcagaagcacagaagcctgaagactgggatgacgaggaagatggtgaatggaaagccccaatgatccctaaccctgaatataagggaccatggaagccaaagaaaataaagaaccccaactaccaaggaaaatggaaggcacccatgattgacaatccagatttcaaggatgatcctgaaatctatgtctaccccaatctcaaatatgttgctattgagttgtggcaggtcaagtcgggaacccttttcgacaatgttttggtatgtgatgatcccgagtatgcgaagaagttggttgaggaaacatggggaaagcaaaaagatgctgaaaaagcggcttttgatgaggaagagaagagaaaggaagaagaggaagcaaaggcagctgaagctgaaggatcggatgatgagaaagaggatgatgcagatgcagatgctgatgctgacgctgatgacgaagaagaagaggcaaaacatgatgaattatagaatgtttggcacttttgaatcgtgccggacaatttaaaggataactcttagctatttt

SEQ ID NO: 113 - protein, 409 aa, Amborella trichopoda
MAGRSLLCLLSFLLLIQNPLAKVLFEERFDDGWEKRWVVSDWKKDENMSGQWIHTSGKWTGDPNDKGIQTSEDYRFFAISAEFPVFSNKDKTLVFQFSVKHEQKLDCGGGYMKLLSDDVDQKKFGGETPYSIMFGPDICGYSTKKVHAILSRNGTNHLIKKEVPCETDQLTHAYTFIIRPDATYSILIDNNEKQTGSLYSDWDILPPKKIKDPEAKKPEDWDDKEYIPDPEDKKPEGYDDIPKEIVDSEAQKPEDWDDEEDGEWKAPMIPNPEYKGPWKPKKIKNPNYQGKWKAPMIDNPDFKDDPEIYVYPNLKYVAIELWQVKSGTLFDNVLVCDDPEYAKKLVEETWGKQKDAEKAAFDEEEKRKEEEEAKAAEAEGSDDEKEDDADADADADADDEEEEAKHDEL

SEQ ID NO: 114 - DNA, 1606 bp, Brachypodium distachyon
ccacgcgtccggagaggttttgttggatctgggccggtgagaagggttgttggggttgtggactgggagtgagagctctcggaaggggtctgtctacaccatgcccgccctcgcgaggtcgccgtccttcgccgtgctggccgtgctcgcgctcgccaccgccgtcgccggcgaggtcttcttccaggagaagttcgacgatggatgggtggatcggtgggtgaagtcggagtggaagaaggaggacaacacggccggcgagtggaaccacacttccggcaaatggaacggtgatgccgaggacaaagggatccagacctccgaggactacaggttctacgccatctcggcgcagttcccggagttgagcaacaaggacaagaccctggttctgcagttctccgtcaagcatgagcagaagctcgactgtggtggtggctatgtcaagctgctcggcgctgatattgaccagaagaagtttggcggcgagacaccttacagcattatgtttgggccggatatctgtgggtacgccaccaagaaggtgcatgctatcctcaccaagaatggcaagaaccatctgatcaagaaggaggtgccgtgcgagacagatcagctgacacatgtgtacacattgatcatccgtcctgatgccacttacagcattctaattgacaacgccgagaagcaaactggcagcatctatgatgactgggacattctccctgcaaagaagatcagggatcctgaagccaagaagccagaagattgggtagatgaggaatacattcctgatcctgaggataagaagccagagggttatgacgatattcccaaagaaattactgatcctgaggcaacgaagccggaggactgggacgatgaggaagatggtgaatggacagctccaaccatgccaaaccccgagtacaagggaccatggacgcaaaagaaaattaagaacccggaatacaagggcaaatggaaggcacctttgattgacaaccctgatttcaaggatgatccttacatctacgcttttgacagtttgaagcacattggcattgagctgtggcaggttaaatcgggaactctgtttgacaatatcctgatcacggatgaccctgagtacgccaagaaggtcgcagaggagacctgggccaagcacaaagatgctgagaaggccgcctttgacgaggctgagaagaagagactcgaggaggaatctgcaagcagcaaggatgatgaccttgatgacgatgaaagatgctaatgacacagatgaggacgaggatgagagcaagtcttccggtgtcgatgccaaggatgactctgacgatgagaagccacagcatgcaaacaaggacgagaaggctgaggaagttagcaaggatgctccttctactaagaaggacgagctttaggatgtggggggttaaagatgcagattaagtcggtcagggtgtatttctttttcccattggggtttgcagtagagctatcccgttaactagacttggaaattatctctgaaagtaagatgagaagtaattcgatcttggatcttgtaaggccccgttttagaacacagttttttttttggagg

SEQ ID NO: 115 - protein, 390 aa, Brachypodium distachyon
MPALARSPSFAVLAVLALATAVAGEVFFQEKFDDGWVDRWVKSEWKKEDNTAGEWNHTSGKWNGDAEDKGIQTSEDYRFYAISAQFPELSNKDKTLVLQFSVKHEQKLDCGGGYVKLLGADIDQKKFGGETPYSIMFGPDICGYATKKVHAILTKNGKNHLIKKEVPCETDQLTHVYTLIIRPDATYSILIDNAEKQTGSIYDDWDILPAKKIRDPEAKKPEDWVDEEYIPDPEDKKPEGYDDIPKEITDPEATKPEDWDDEEDGEWTAPTMPNPEYKGPWTQKKIKNPEYKGKWKAPLIDNPDFKDDPYIYAFDSLKHIGIELWQVKSGTLFDNILITDDPEYAKKVAEETWAKHKDAEKAAFDEAEKKRLEEESASSKDDDLDDDERC

SEQ ID NO: 116 - DNA, 1507 bp, Brassica napus
gtcgacgatttcgtccgatctgagttttagcaatggcgaaactaatccttggcctcgtatccttgattcttatcggactcgtcgcgatcgcttccgccgcagttatcttcgaggagcgctttgatgatggatgggagaacaggtgggttaaatctgagtggaagaaagatgaccagtctgctggggagtggaaccacacttctggaaattggtctggtgatgctaatgataaaggtatccagaccagtgaggactacagattctacgccatttcagctgagttccctgaattcagcaacaaggacaaaaccttagtcttccaattctcagtcaagcacgagcaaaagcttgactgtggtggtggctacatgaagctcctcagtggtgatgttgaccagaagaaatttggtggcgacactccatacagcatcatgtttggtcccgatatctgtggctacagcacgaagaaagtgcatgctatccttacctacaatgacgccaaccacctgatcaagaaggatgttccctgtgaaactgaccagctcacccatgtctacacattcatcctccgcccagatgctacttacagcattctcattgacaatgttgagaagcaaaccggtagcctgtactctgactgggatcttcttccacccaagaagatcaaggaccccagtgccaagaagcctgaggactgggacgagcaagagtacattccagaccctgaagacaagaaacctgacggatacgatgatatcccaaaggagatcccagataccgatgcaaagaagcctgaggactgggatgaagaagaagatggtgagtggactgccccgaccgttcccaaccctgagtacatgggtgaatggaagcccaagcaaatcaagaaccccaattacaagggcaagtgggaggctccagaaattgacaaccctgactttaagaatgactcagagctgtatgtcttccccaagctaaagtatgttggaatcgaattgtggcaggtgaaatcaggatcattgttcgacaatgttttgatctgcgatgacccagactacgccaagaagttggcagatgaaacatggggcaagctcaaggatgcggagaaagcagctttcgatgagattgagaagaagaaagaggaagaggaatccaaggacgctcctgcggaaactgatgctgaagatgaagcagaggaagatgaaggagatgagtctgacactgaagctaagaccgaagccaaatcagaagttagcgaggagacctcagacaaagacgccactgctcatgatgagctgtgagcgaaaagaggttgaagattgaagaccaaagttttcgagtctctgtttcatgtttttatcctttcttttgaagtatttttagcagtctagtattagcatataatgatacaatgatatgacgatcacaggctctttttgtactgaacaccataagatgacattttgcaattacatctctttccctactaaagaaaaaaaaaaaaaaa

SEQ ID NO: 117 - protein, 422 aa, Brassica napus
MAKLILGLVSLILIGLVAIASAAVIFEERFDDGWENRWVKSEWKKDDQSAGEWNHTSGNWSGDANDKGIQTSEDYRFYAISAEFPEFSNKDKTLVFQFSVKHEQKLDCGGGYMKLLSGDVDQKKFGGDTPYSIMFGPDICGYSTKKVHAILTYNDANHLIKKDVPCETDQLTHVYTFILRPDATYSILIDNVEKQTGSLYSDWDLLPPKKIKDPSAKKPEDWDEQEYIPDPEDKKPDGYDDIPKEIPDTDAKKPEDWDEEEDGEWTAPTVPNPEYMGEWKPKQIKNPNYKGKWEAPEIDNPDFKNDSELYVFPKLKYVGIELWQVKSGSLFDNVLICDDPDYAKKLADETWGKLKDAEKAAFDEIEKKKEEEESKDAPAETDAEDEAEEDEGDESDTEAKTEAKSEVSEETSDKDATAHDEL

SEQ ID NO: 118 - DNA, 1492 bp, Brassica napus
agagcatcttcctgtaggcttgtaggatctgactattttcgaggaaggtgcgatctgagtttccagcgatggcgaaactaaaccccaacttcatctctctgattcttatcggcctcgtcgcgatcgcctctgctagtgttatattcgaggaaaaattcgaagatggatgggagaagagatgggtaaaatctgactggaagaaagatgacaacactgctggggaatggagccacacagctggcaactggtctggtgacgctaacgacaaaggtatccagactagcgaggactacagattctacgccatatcagctgagttccctgagttcagcaacaaggacaagacccttgtcttccaattctctgtcaagcacgagcagaagcttgactgtggcggtggatacatgaagcttctcagtggtgatgttgaccagaagaaattcggtggagacactccttacagcatcatgtttggtcctgatatctgtggctacgacactaagaaagtgcatgctatccttacctacaatggaacaaaccatctgatcaagaaggaggttccatgtgagactgatcagctcacacatgtctacacgttcatcctccgcccggatgctacttacagtattcttatcgataacgttgagaagcaaactggtagcctctactctgactgggatctcctcccagctaagaagattaaggatcctagcgccaagaagcctgaggattgggatgacaaagagtacattcctgatcctgaagacacaaagccagctgaatacgatgacatcccaaaggagatcccagacgctgatgcaaagaagcctgaggactgggatgatgaagaagatggtgagtggactgcccctaccattcccaaccccgagtacaacggtgaatggaagcccaagaaaattaagaaccctaactacaagggaaaatggaaggctccaatgattgacaaccctgacttcaaggatgacccagaactctacgtcttccccaaattgaagtatgttggagtggagttgtggcaggtgaaatctggatcattgttcgacaatgtcttggtctgcgatgacccggagtacgctaagcagttggctgaggaaacctggggaaagctcaaggatgctgagaaagcagcattcgacgaagctgagaagaagagagaggaagaggaatcaaaggatgctcccactgctgattctgatgctgaggatgaacaagaggacgatgaccatgaaggagatgaatccgacactgattcaaaaactgaggaaaccaaggtagaaacctcctcagacaaggatgatgccgcccatgacgagctctgagcagaagaaggatccaacaagtttccagagtcgtttgattttctttttaaagaattattttagcgctagtttgttggggatattagaactttttttagctaccaaaaaaatatgatgaaatggtgagcgtggcagcttgttttagacttgat

SEQ ID NO: 119 - protein, 423 aa, Brassica napus
MAKLNPNFISLILIGLVAIASASVIFEEKFEDGWEKRWVKSDWKKDDNTAGEWSHTAGNWSGDANDKGIQTSEDYRFYAISAEFPEFSNKDKTLVFQFSVKHEQKLDCGGGYMKLLSGDVDQKKFGGDTPYSIMFGPDICGYDTKKVHAILTYNGTNHLIKKEVPCETDQLTHVYTFILRPDATYSILIDNVEKQTGSLYSDWDLLPAKKIKDPSAKKPEDWDDKEYIPDPEDTKPAEYDDIPKEIPDADAKKPEDWDDEEDGEWTAPTIPNPEYNGEWKPKKIKNPNYKGKWKAPMIDNPDFKDDPELYVFPKLKYVGVELWQVKSGSLFDNVLVCDDPEYAKQLAEETWGKLKDAEKAAFDEAEKKREEEESKDAPTADSDAEDEQEDDDHEGDESDTDSKTEETKVETSSDKDDAAHDEL

SEQ ID NO: 120 - DNA, 1557 bp, Beta vulgaris
gctcaaatttctctctctttctcactctcctcaagagttaacaatggagaatcgggggcgaaaccctagctttctctctctcctccttcttctctctcttttcgccatcgcatctgctaaagtcttcttcgaggaacgtttcgaagatggatgggagaagcgttgggtcaaatctgaatggaagaaggatgaaagtatggctggagagtggaattacacatccggcaaatggaacggagatgccaatgacaaaggtatccagactagcgaggactacagattctatgctatctctgctgaattcccagaattcagcaacaaagataataccttggttttccagttttctgttaagcatgaacagaagcttgattgtggaggtggttacatgaagttactcagtggtgaagttgaccagaagaaatttggtggggataccccatacagcattatgtttggccctgatatctgtgggtacagtactaagaaagtccatgccattttcaactacaatgatacaaatcacttgatcaagaaggatgtcccttgtgagactgaccaattgactcatgtgtacaccttcattctccgcccagatgctacctacagcatcctcatcgacaaccaggagaaacaaactggtagtctttacactgactgggacctacttcctgctaagaaaatcaaggatcctgaggctaagaagcccgaggattgggatgacaaggagttcattcctgaccccgaagacaagaagccagagggttatgacgacatcccagcagagattactgaccctgaggctaagaagccggaggactgggatgatgaggaagatggtgaatggactgccccaaccattccaaaccccgagtacaagggcccatggaaagcaaagaaaatcaagaaccccaactacaagggcaagtggaaggcacccatgatcgacaacccagaattcaaggatgacccagaactgtatgtttaccccaagctcagatatgttggcgttgagttgtggcaggtgaagtctggcacactctttgacaacgtcttggtctgtgatgaccctgagtatgcaaagcagttggctgaggaaacctggggaaagcaaaaggatgctgaaaaggctgcttttgaggagcttgagaagaagagagaagaggaggaaaccaaggatgatcccgttgaatcagatgctgaggatgaagatgaagctgaagccgacgactctgataaggatgatgctgataaatccgatgacaaggatgacgatcaacatgatgaactgtgagtactcgagcagtatcaaggagaattctaattcagactcattgttcacaagcaattttctcttatcaatttttagcataggtttttggtagtagacttaaaaagacaccaaatcaaaagcctgtatgacatattagtttttctcattcggctgtatttggtggataatagctaaagggccaaggagatttccagttttcttattacacatttaaacatgaaatagagattctggaatggtaaatgagctgagttattctaatt

SEQ ID NO: 121 - protein, 416 aa, Beta vulgaris
MENRGRNPSFLSLLLLLSLFAIASAKVFFEERFEDGWEKRWVKSEWKKDESMAGEWNYTSGKWNGDANDKGIQTSEDYRFYAISAEFPEFSNKDNTLVFQFSVKHEQKLDCGGGYMKLLSGEVDQKKFGGDTPYSIMFGPDICGYSTKKVHAIFNYNDTNHLIKKDVPCETDQLTHVYTFILRPDATYSILIDNQEKQTGSLYTDWDLLPAKKIKDPEAKKPEDWDDKEFIPDPEDKKPEGYDDIPAEITDPEAKKPEDWDDEEDGEWTAPTIPNPEYKGPWKAKKIKNPNYKGKWKAPMIDNPEFKDDPELYVYPKLRYVGVELWQVKSGTLFDNVLVCDDPEYAKQLAEETWGKQKDAEKAAFEELEKKREEEETKDDPVESDAEDEDEAEADDSDKDDADKSDDKDDDQHDEL

SEQ ID NO: 122 - DNA, 1617 bp, Capsicum annuum
ggcacgaggattttccaatcgccatggctactcaacgaagaaaaagccctagctctctctatctcattgctgttttctctctacttgtagcttccgccgccgccaaagttttcttcgaggaaaatttcaatgatggctgggagagcagatgggtgaaatctgattggaagaaagacgagaacatggccggagagtggaatcacacctctggcaagtggagtggagacgctaatgacaaaggtatccagaccagtgaagactacaggttctatgccatttcggctgagttccctgaatttagtaacaagggaaagaacctagtgttccagttctctgttaagcatgagcaaaagcttgactgtggtggtgggtacatgaagttgattagtggggatgttgaccaaaagaaattcggtggtgatactccctacagtatcatgtttggaccagatatctgtggctacagcaccaagaaggtccacgctattctcacttataacgacacaaaccacctgatcaagaaggaagtcccatgtgagactgatcaactgacccatgtctacactttcatcctccgccctgatgccacatacagcattctcattgacagtgtggagaaacagtctggtagcttgtactctgactgggacattctcccaccaaagacgatcaaggatccaagtgccaagaaacctgaagattgggatgacaaggaattcattgatgatcctgaggataagaagccagagggctatgatgacattccagaagagataactgatcctgatgccaagaagccagaggactgggatgatgaagaagatggtgaatggacagccccaaccattcctaacccggagtacaagggcccatggaaggcaaagaaaattaagaaccccaactacaaggggaagtggaaggctcctatgattgataacccagagttcaaggatgacccagatctctatgttttcccaaaattgaagtatgtgggagttgaattgtggcaagtgaaatctggaaccttgtttgacaatgttgtcataaccgatgatccagagtatgccaagtcagttgctgaggaaacatggggaaagcagaaggatgcggaaaaggctgcttttgaagaagcagaaaagaagagagaggaggaggaatcaaaggctgctccagctgattctgacgccgaggatgatgatgaggctgattcagatgatgctgatgatgctgatgacaagtctgagtccaaggatgatgatgaagcagcacatgatgaactgtaagggctaagcattttgattcaagctgacaaaagaagcttcccggaagatttcctccccccactctctcccttccccctttctttttttcctttttattagtgaattagcccctttccatttttagtgaaaagacccagattgagggtgcatgaagtcgtgtatggctgattgctttgatgtcattgggactcggccaataggaatacatgtttcgttttgactagaattttacttaattatgttgaaattactatctaaattttctatttgtcttgctccttaactctaattcaacgtgacaagtaaattaattggctgccaccatttcaatctc

SEQ ID NO: 123 - protein, 419 aa, Capsicum annuum
MATQRRKSPSSLYLIAVFSLLVASAAAKVFFEENFNDGWESRWVKSDWKKDENMAGEWNHTSGKWSGDANDKGIQTSEDYRFYAISAEFPEFSNKGKNLVFQFSVKHEQKLDCGGGYMKLISGDVDQKKFGGDTPYSIMFGPDICGYSTKKVHAILTYNDTNHLIKKEVPCETDQLTHVYTFILRPDATYSILIDSVEKQSGSLYSDWDILPPKTIKDPSAKKPEDWDDKEFIDDPEDKKPEGYDDIPEEITDPDAKKPEDWDDEEDGEWTAPTIPNPEYKGPWKAKKIKNPNYKGKWKAPMIDNPEFKDDPDLYVFPKLKYVGVELWQVKSGTLFDNVVITDDPEYAKSVAEETWGKQKDAEKAAFEEAEKKREEEESKAAPADSDAEDDDEADSDDADDADDKSESKDDDEAAHDEL

SEQ ID NO: 124 - DNA, 1433 bp, Cichorium endivia
ggcgggatctcctttctagctctggtcatggcgacacagaaatttagcgggatcgcatttctctctctactactgctcatctccattgcttctgccaaggtgttcttcgaggaacgttttgacgatggatgggaaagccgatgggtcaaatctgactggaagaaagaggacaatatggctggggagtggaattacacatctggtaaatggaatggagatgccgaagataaaggtatccaaacaagtgaagactacaggttttatgccatatctgctgaataccctgaattcagcaacaaagataaaacactagtcttccaattttctgtcaaacatgaacagaaacttgattgcggtggtggatacatgaaattgatgagtggtgatgtggaccaaaagaaatttggtggcgataccccttacagtatcatgtttggacctgatatttgtgggtatgcaacaaagaaagttcatgcgattcttacatacaatggagaaaacaaattgatcaagaaagatgttccgtgtgaaacagaccaacttacacatgtttatacatttattcttcgccctgatgctacatacagtatcctcattgacaatgaagagaaacaaacaggaagcttgtataaggattgggatcttctcccaccaaagcagatcaaggaccccgaggccaaaaagcctgaagattgggatgagaaggaatacatttctgatcctgaagataagaagcctgagggctatgatgatatcccaaaggagatcccggatccagatgcgaaaaagccagaagattgggatgatgaggaagatggtgaatggacagtaccaactattccaaaccctgagtacaagggtccatggaaggcaaagaaaatcaagaaccctaactacaaagggaagtggaaggcaccaataattgacaacccagattttaaggacgaccctgagctctatgtattccccaagctgaagtatgttggcattgagttgtggcaggttaaatctggaactttgtttgacaacgtattgatatgtgatgatcctgaatatgccaaacaactagtagaagaaacttgggccaaacaaaaagatgctgaaaaggctgcatttgaagaactagaaaagaaacgggaggaagaggaattaaaggatgatcatgttgattctgatgcggatgatgagggcaatgatagtgatgaagccgaaccagaggaggaagaggaagcagatgataatgatatcaaggatgaactataggggaagtgtcgattgcaaactatccaaaatataaacttgagatgtgagttgttagacattgagagaacttttccctttcttttatagtttgtgttttaggccactttgaatagaaatataaaaacaaatttgaggctgtattcagatcttgtttcgttggactgaatttg

SEQ ID NO: 125 - protein, 411 aa, Cichorium endivia
MATQKFSGIAFLSLLLLISIASAKVFFEERFDDGWESRWVKSDWKKEDNMAGEWNYTSGKWNGDAEDKGIQTSEDYRFYAISAEYPEFSNKDKTLVFQFSVKHEQKLDCGGGYMKLMSGDVDQKKFGGDTPYSIMFGPDICGYATKKVHAILTYNGENKLIKKDVPCETDQLTHVYTFILRPDATYSILIDNEEKQTGSLYKDWDLLPPKQIKDPEAKKPEDWDEKEYISDPEDKKPEGYDDIPKEIPDPDAKKPEDWDDEEDGEWTVPTIPNPEYKGPWKAKKIKNPNYKGKWKAPIIDNPDFKDDPELYVFPKLKYVGIELWQVKSGTLFDNVLICDDPEYAKQLVEETWAKQKDAEKAAFEELEKKREEEELKDDHVDSDADDEGNDSDEAEPEEEEEADDNDIKDEL

SEQ ID NO: 126 - DNA, 1457 bp, Centaurea solstitialis
gcggggacccactctgtgtaccatggcgaaactgaggctaaaccctagctctctcggccttctctctcttctgctactcctctccgtcgcttctgctaaggtgttcttcgaggaacgcttcgaagatggatgggaaagccggtgggttaaatctgattggaagaaagaggagaacacggctggggagtggaattacacatctggtcaatggactggagatgccaacgataaaggaattcagaccagtgaagactacaggttttacgccatatcagcagagtaccctgagtttagcaacaaggataagactctagttttccaattttctgttaagcatgagcagaagcttgattgtggtggtggatacatgaaattgctcagtggtgatgtggatcaaaagaaatttggtggtgatacaccatacagcatcatgtttggacctgatatctgtgggtatgccacaaagaaggttcatgcaattcttacatacaatggggaaaacaaattgatcaagaaagatgtcccttgtgagactgaccagcttacacatgtttataccttcatcctccgccctgatgccacctacagtatcctcattgataatgtggagaagcaaacaggaagcttgtactctgattgggatcttctcccagcaaagcagataaaggacccagaggcaaaaaagcctgaagattgggatgagaaggagttcattgctgaccctgaagacaagaaaccagagggttacgatgacatcccagaggagattgcagacccagatgccaaaaagccagaagactgggatgaggaggaagatggtgagtggacagtcccaactattcccaaccctgagtacaagggtccatggaaggcaaagaaaatcaagaaccccaactacaaagggaagtggaaggcacctttgattgacaacccagattttaaggatgaccctgatctctacgttttccccaagttgaagtatgttggcatagagctgtggcaggttaaatctggaactttgtttgacaatgtcttgatatgcgatgatcctgaatatgccaaacaagtggcagaagaaacatggggcaaacaaaaagatgctgagaaggcagcatttgaagagctagaaaagaaaaaggaggaggaggaatcaaaggatgatccagctgattctgatgccgaaaatgatgatgctgaaccggaggatgatgacgaagccgaagaaagcgatgtgaaggatgagctatagatagaggatctgatattgcaaaacataaaacgagatgtgggaggatgagttagaagaattgttttagggtgttatgtttttttatgatagatgatgatgtaaaacaattgagaagggatacgaatcactttgatctccggagaacaaacaaggctggatgtggaacattaacatgtgtgtttttgtatgaccaattgcttcaaactct

SEQ ID NO: 127 - protein, 408 aa, Centaurea solstitialis
MAKLRLNPSSLGLLSLLLLLSVASAKVFFEERFEDGWESRWVKSDWKKEENTAGEWNYTSGQWTGDANDKGIQTSEDYRFYAISAEYPEFSNKDKTLVFQFSVKHEQKLDCGGGYMKLLSGDVDQKKFGGDTPYSIMFGPDICGYATKKVHAILTYNGENKLIKKDVPCETDQLTHVYTFILRPDATYSILIDNVEKQTGSLYSDWDLLPAKQIKDPEAKKPEDWDEKEFIADPEDKKPEGYDDIPEEIADPDAKKPEDWDEEEDGEWTVPTIPNPEYKGPWKAKKIKNPNYKGKWKAPLIDNPDFKDDPDLYVFPKLKYVGIELWQVKSGTLFDNVLICDDPEYAKQVAEETWGKQKDAEKAAFEELEKKKEEEESKDDPADSDAENDDAEPEDDDEAEESDVKDEL

SEQ ID NO: 128 - DNA, 1517 bp, Gossypium hirsutum
gtctgcagctctacttattttttttctcttagatgagtacaaccatggcgaatcacaaacggttccctaatttcgtatctcttattctcctctctctcgtcgccaccgcttctgctgaagttttcttcgaagaacgcttcgaagatggatgggaaagtcgttgggtaaaatctgactggaagaaagatgagaacatggctggggaatggaattacacttctggaaaatggaatggagatcttaatgacaaaggtattcaaactagtgaagactacaggttttatgctatttcagctgagttcccagaagttaacaacaagggaaagactctagtcttccaattttctgtgaagcacgagcagaagcttgactgtggtggtggctacatgaagttgctcagtggtgatgttgaccagaagaaatttggcggtgacaccccgtacagcatcatgtttggccctgatatttgcggctacagcaccaagaaagtacatgccattcttacatacaatgggacaaattacttgatcaaaaaggaagttccttgcgagactgaccaactcactcatgtttatacattcattctccgtccagatgctacctacagcatccttattgataatgttgagaaacaaactggtagcttatacactgattgggatctcctcccaccaaagaagatcaaggatcctgaggccaagaagcctgaagattgggatgacaaggaatacatccctgatcctgaagacaaaaagccagagggttatgatgacattccaaaagagattcctgatcctgatgctaagaagcctgaagattgggatgatgaagaagacggtgaatggacaccctcaacaattcccaaccccgagtacaagggcccatggaagccaaagaaaatcaagaaccccaactacaagggcaagtggaaggcaccaatgattgacaacccagatttcaaggatgatccagatctctatgttttccccaacttgaagtatgtcggtattgaattgtggcaggtaaaatctggaacaatgtttgataacatcttagttgccgatgatgtagagtatgccaagaaactagctgaagaaacatggggcaagcagaaggatgctgaaaaggcagcgtttgaggaggcagagaaaaagagagaggaggaatcaaaggatgacccagttgattccgatgctgaggatgaagatgatgccgatgatactgaagggcacgagtctgattccgataccaaatcagacgatgatgacaaggaagatgctcatgatgagctctaagcactgcaatatctcgcagacaattcggtttggtataaatttttccctaccctttattttaaaaaaaaagttctagttttaggagtttcctgttagaggaaaaaggaattgaatgcttcaggcaaaagaactttcactgatgctttcttaatatgattttaactgtctgaacaaaggcatgctctttttcttttttatgatcactagatatttttactattc

SEQ ID NO: 129 - protein, 420 aa, Gossypium hirsutum
MSTTMANHKRFPNFVSLILLSLVATASAEVFFEERFEDGWESRWVKSDWKKDENMAGEWNYTSGKWNGDLNDKGIQTSEDYRFYAISAEFPEVNNKGKTLVFQFSVKHEQKLDCGGGYMKLLSGDVDQKKFGGDTPYSIMFGPDICGYSTKKVHAILTYNGTNYLIKKEVPCETDQLTHVYTFILRPDATYSILIDNVEKQTGSLYTDWDLLPPKKIKDPEAKKPEDWDDKEYIPDPEDKKPEGYDDIPKEIPDPDAKKPEDWDDEEDGEWTPSTIPNPEYKGPWKPKKIKNPNYKGKWKAPMIDNPDFKDDPDLYVFPNLKYVGIELWQVKSGTMFDNILVADDVEYAKKLAEETWGKQKDAEKAAFEEAEKKREEESKDDPVDSDAEDEDDADDTEGHESDSDTKSDDDDKEDAHDEL

SEQ ID NO: 130 - DNA, 1670 bp, Glycine max
cacgagctacacatccctagctctgtcgttccgtcgttgacgatggcgtttcgggtgcgaagccctgacctccgctctctctttcttctctctctcttgtccatcgcttccgccaatgtcttcttcgaagagcgtttcgatgacgggtgggaaaatcgatgggttaaatcagattggaaaaaagatgagaacgtggctggggagtggaaccacacctctggtcaatggaatggagacgctaatgacaaaggtattcaaaccagtgaggattacagattctatgctatttcagctgagtaccctgaattcagcaacaagggtaagacactagtctttcaattttctgttaagcacgaacagaagcttgactgtggtggtggctacatgaagttgctcagtggggatgttgatcagaagaaatttggcggggatactccttacagtattatgtttggcccagatatctgtggttacagtacaaagaaagttcacgctattcttacctacaatgacacaaaccacttgataaagaaggatgttccttgtgagactgaccaacttactcatgtttacacatttatcctccgtccggatgcaacctacagcatcctgattgataatgtggagaagcaaactggtagtctctactctgattgggatcttctccctccaaagacaatcaaggatcctgaggctaaaaaaccagaagattgggatgacaaagaatatattcctgatcctgaggataagaaaccagaggggtatgatgacatcccaaaagagctcccagaccccgaagccaagaagcctgaagattgggatgatgaggaagatggtgagtggacaccccctaccattgccaaccctgagtacaagggcccatggaaggcagagaaaatcaagaaccccaactataaaggaaaatggaaggcaccattgattgataacccagatttcaaggatgaccccgacctctatgttttccccaacttgaagtacgtggggattgaattgtggcaggtgaaatctggtactttgtttgacaatgtcttaattactgatgatcctgagtatgctaagcagctggttgaagaaacatggggcaagcacaaggatgctgagaaggcagcatttgaggaggccgagaagaagagggaagaggaggaatcaaaggatgacccagttgactctgatgctgatgaggaagaggaagatgctgatgaagctggcaatgactccgatgctgaatcaaagacggaagctggagaagacaccaaggaagagggtgtacatgatgaactctaggaagtttgcaaaacggataaagagtgagcggaagttatattccggaaagttatatctttttcagttgtagtgtttttttgtttttatttttccctagataagcagaccgtggaaaactgcaagtgaaagctggagcttttgcttcaatcacatttgactatttcactgattagaacaggcaaagatgtctcttttgggttgatctttttatgtttcgatcaattgaattttccattatgacaccgtcctgaaaatctaattaattgcaaaaaaggattatctttgttaatcgtttgctaagctagtttgagagctactagaaattttacttgtcaagttataatatgtggcgcatggttggctaa

SEQ ID NO: 131 - protein, 420 aa, Glycine max
MAFRVRSPDLRSLFLLSLLSIASANVFFEERFDDGWENRWVKSDWKKDENVAGEWNHTSGQWNGDANDKGIQTSEDYRFYAISAEYPEFSNKGKTLVFQFSVKHEQKLDCGGGYMKLLSGDVDQKKFGGDTPYSIMFGPDICGYSTKKVHAILTYNDTNHLIKKDVPCETDQLTHVYTFILRPDATYSILIDNVEKQTGSLYSDWDLLPPKTIKDPEAKKPEDWDDKEYIPDPEDKKPEGYDDIPKELPDPEAKKPEDWDDEEDGEWTPPTIANPEYKGPWKAEKIKNPNYKGKWKAPLIDNPDFKDDPDLYVFPNLKYVGIELWQVKSGTLFDNVLITDDPEYAKQLVEETWGKHKDAEKAAFEEAEKKREEEESKDDPVDSDADEEEEDADEAGNDSDAESKTEAGEDTKEEGVHDEL

SEQ ID NO: 132 - DNA, 1620 bp, Gossypium raimondii
tttttttttctcttagatgagtacaaccatggcgaatcacaaacggttccctaatttcgtatctcttattctcctctctctcgtcgccaccgcttctgctgaagttttcttcgaagaacgcttcgaagatggatgggaaagtcgttgggtaaaatctgactggaagaaagatgagaacatggctggggaatggaattacacttctggaaaatggaatggagatcctaatgacaaaggtattcaaactagtgaagactacaggttttatgctatttcagctgagttcccagaagttaacaacaagggaaagactctagtcttccaattttctgtgaagcacgagcagaagcttgactgtggtggtggctacatgaagttgctcagtggtgatgttgaccagaagaaatttggcggtgacaccccgtacagcatcatgtttggccctgatatttgcggctacagcaccaagaaagtacatgccattcttacatacaatgggacaaatcacttgatcaaaaaggaagttccttgcgagactgaccaactcactcatgtttatacattcattctccgtccagatgctacctacagcatccttattgataatgttgagaaacaaactggtagcctatacactgattgggatctcctcccaccaaagaagatcaaggatcctgaggccaagaagcctgaagattgggatgacaaggaatacatccctgaccctgaagacaaaaagccagagggttatgatgacattccaaaagagattcctgatcctgatgctaagaagcctgaagattgggatgatgaagaagatggtgaatggacaccctcaacaattcccaaccccgagtacaagggcccttggaagccaaagaaaatcaagaaccccaactacaagggcaagtggaaggcaccaataattgacaacccagatttcaaggatgatccagatctctatgttttccccaacttgaagtatgtcggtattgaattgtggcaggtgaaatctggaacaatgtttgataacatcttagttgccgatgatgtagagtatgccaagaaactagctgaagaaacatggggcaagcagaaggatgctgaaaaggcagcatttgaggaggcagagaaaaagagagaggaggaggagtcaaaggatgccccagttgattccgatgctgaggacgaagatggtgctgatgatactgaagggcacgagtctgattccgataccaaatcagacgatgaggacaaggaagatgcacatgatgagctctaagcactgcaatatttcgctgacaattcggtttggagataaaaaggccaaaatcttccttacccttaataaaaaaagtttctagtcttaggagtttcctgttggaattgaatgctacaggcaaaagaactttcactgatgctttcttagtacgagtttaactgtctgaacaaaggcacactcttttcctgtttttatgatcactagattttttttattttatgtttactattaagttcccagcgctgtcaattgcaaattccgaaaggtaatcaaatcaaatatgaaaaaggtaaactacacgggatattaagaagttcactttttggtgagttagcttt

SEQ ID NO: 133 - protein, 421 aa, Gossypium raimondii
MSTTMANHKRFPNFVSLILLSLVATASAEVFFEERFEDGWESRWVKSDWKKDENMAGEWNYTSGKWNGDPNDKGIQTSEDYRFYAISAEFPEVNNKGKTLVFQFSVKHEQKLDCGGGYMKLLSGDVDQKKFGGDTPYSIMFGPDICGYSTKKVHAILTYNGTNHLIKKEVPCETDQLTHVYTFILRPDATYSILIDNVEKQTGSLYTDWDLLPPKKIKDPEAKKPEDWDDKEYIPDPEDKKPEGYDDIPKEIPDPDAKKPEDWDDEEDGEWTPSTIPNPEYKGPWKPKKIKNPNYKGKWKAPIIDNPDFKDDPDLYVFPNLKYVGIELWQVKSGTMFDNILVADDVEYAKKLAEETWGKQKDAEKAAFEEAEKKREEEESKDAPVDSDAEDEDGADDTEGHESDSDTKSDDEDKEDAHDEL

SEQ ID NO: 134 - DNA, 1498 bp, Gossypium raimondii
cactaatggcgattcctaaacgaaaccctattttcctatctgtaatctttgtttcgctcctcgccatcgcctccgctaaagtattcttcgaagaacgttttgatgagggatgggaaagtcggtgggtaaaatctgactggaaaaaggatgagaacatggctggggagtggaattacacttctggaaaatggaatggagatcctaacgacaagggtattcaaactagtgaagactacaggttctatgctatttcagctgagttcccagaagtcaacaacaaagataagactctagtcttccaattttctgtcaagcatgagcaaaagcttgattgtggtggtggctacatgaagttgctcagcggtgacattgaccagaagaaatttggtggtgaaaccccatacagcatcatgtttgggcctgatatctgcggctatagcactaagaaagtgcatgctattctcacctacaatgggacaaaccacttgatcaaaaaggaagttccttgtgagactgaccaactcactcatgtttatacgttcattctccgtccggatgctacctacagtatccttgttgacaatgttgagaaacaaactggtagcttgtacactgattgggatcttctcccacctaagaaaataaaggatcctgaggccaagaagcctgaagattgggatgacaaggaatacatccctgatcccgaagacaagaagcctgagggttatgatgacattccaaaagaaattccagatcctgatgctaagaagcctgaagattgggatgatgaagaagatggtgaatggacaccttcaactattcccaatcctgaatacaagggcccatggaatccaaagaaaatcaagaaccccaactacaagggcaagtggaaggcaccaatgattgacaaccctgatttcaaggatgatccggatctctatgttttccccagcttgaagtatgttggtattgagttgtggcaggtgaaatcgggaacaatgtttgataacatcttagtcgctgatgatgtagagtatgccaagaaactagctgaagaaacatggggcaagcagaaggatgctgagaaggcagcatttgaggaggaagagaagaagaaagaggaagaggaatcgaaggatgagccagttgattccgatgctgaggacgacgatgatgatactgatgatggtgaaggaagtgagtcggattcaagcaaagatagtgctgaggaagatgcagtacaacatgatgagctataaggcaagaggaatacagtatttcgctggcaatttggttgagagcttaaacacaagtgcttaaattttcctgtagtatctttttaagatgtaatcttattagtttttatttagataaaaaaggaattgaatgctggcaagagaaaagtttgagtgacgcgttttagtatgatttcattaactctgcctaaacgaagcgggcgttttatgacgaaaccaagatttatccaatggttttgacc

SEQ ID NO: 135 - protein, 417 aa, Gossypium raimondii
MAIPKRNPIFLSVIFVSLLAIASAKVFFEERFDEGWESRWVKSDWKKDENMAGEWNYTSGKWNGDPNDKGIQTSEDYRFYAISAEFPEVNNKDKTLVFQFSVKHEQKLDCGGGYMKLLSGDIDQKKFGGETPYSIMFGPDICGYSTKKVHAILTYNGTNHLIKKEVPCETDQLTHVYTFILRPDATYSILVDNVEKQTGSLYTDWDLLPPKKIKDPEAKKPEDWDDKEYIPDPEDKKPEGYDDIPKEIPDPDAKKPEDWDDEEDGEWTPSTIPNPEYKGPWNPKKIKNPNYKGKWKAPMIDNPDFKDDPDLYVFPSLKYVGIELWQVKSGTMFDNILVADDVEYAKKLAEETWGKQKDAEKAAFEEEEKKKEEEESKDEPVDSDAEDDDDDTDDGEGSESDSSKDSAEEDAVQHDEL

SEQ ID NO: 136 - DNA, 1429 bp, Helianthus annuus
attacggccggggaccacactgtgtagcaatggcgattcggaggttaaaccctaaatctctttcatttctctctctactgctgctgttttcgatcgcttctgctaaagtgttctttgaggaacgatttgaagatggatgggagaacaagtgggttaaatccgactggaagaaagatgagaacatggcaggagagtggaactacacttctggcaaatggaatggtgatgccaatgataaaggtattcagacaagtgaagactacaggttttatgccatttcagctgagtaccctgaattcagcaacaaggataagacactagtcttccagttttctgtcaagcatgagcagaagcttgattgcggtggcggctacatgaaactgcttagcggtgatgtggaccaaaagaaattcggtggtgataccccatacagcatcatgtttggacctgatatctgtgggtatgccacaaagaaggttcatgcaatcctcacatacaacggggaaaataagttgatcaagaaagatgttccttgtgaaaccgaccagctctcgcatgtttataccttcgttctccgccccgatgctacttacagtatcttaatcgataatgttgagaagcaaacaggaagcttgtacagtgattgggatcttctcccaccaaagcagattaaggaccccgaggccaaaaagcctgaagattgggatgagaaggagttcatccctgaccctgaagacaagaaacctgagggttatgatgacatcccaaaggagatcccagacccagatgccaaaaagccagaagattgggacgatgaggaagatggtgaatggactgtcccgactattccaaaccccgagtacaagggtccatggaaggcaaagaaaatcaagaacccgaactacaaagggaaatggaaggcacccatgatcgacaacccagattttaaggatgaccctgatctgtatgtcttccccaagttgaagtatgtcggcatagagctgtggcaggtgaaatctggcacattgttcgacaatgtcttgatctgcgatgaccctgaatacgccaaacaagttgcagaagaaacatggggcaaacaaaaagacgctgagaaggccgcatttgaagagctagaaaagaagagggaagaggaggaaaccaaggatgacccagttgattctgatgttgaggataatgatgatgctgaggcagaagaagaggacgacgccgaagaaagtgacgtcaaggatgagctatagagaagaggggttagagtctgagagcagttagaatttgaagatcttttttcttatttcaagacttctaatttgaaaccctttttaatagatagataatgagaaatgtaatgcagaatttctgcccctcattttaattgctttcattggaaactattaaaaagaagtgggag

SEQ ID NO: 137 - protein, 409 aa, Helianthus annuus
MAIRRLNPKSLSFLSLLLLFSIASAKVFFEERFEDGWENKWVKSDWKKDENMAGEWNYTSGKWNGDANDKGIQTSEDYRFYAISAEYPEFSNKDKTLVFQFSVKHEQKLDCGGGYMKLLSGDVDQKKFGGDTPYSIMFGPDICGYATKKVHAILTYNGENKLIKKDVPCETDQLSHVYTFVLRPDATYSILIDNVEKQTGSLYSDWDLLPPKQIKDPEAKKPEDWDEKEFIPDPEDKKPEGYDDIPKEIPDPDAKKPEDWDDEEDGEWTVPTIPNPEYKGPWKAKKIKNPNYKGKWKAPMIDNPDFKDDPDLYVFPKLKYVGIELWQVKSGTLFDNVLICDDPEYAKQVAEETWGKQKDAEKAAFEELEKKREEEETKDDPVDSDVEDNDDAEAEEEDDAEESDVKDEL

SEQ ID NO: 138 - DNA, 1435 bp, Helianthus argophyllus
gacacacactgtgtagcaatggcgattcggaggttaaaccataaatctctttcatttctctctctactgctactgttttcgatcgcttctgctaaagtgttctttgaggaacgatttgaagatggatgggagaacaagtgggttaaatccgactggaagaaagatgagaacatggcaggagagtggaactacacttctggcaaatggaatggtgatgccaatgataaaggtattcagacaagtgaagactacaggttttatgccatttcagctgagtaccctgaattcagcaacaaggataagacactagtcttccagttttctgtcaagcacgagcagaagcttgattgcggtggcggctacatgaaactgcttagcggtgatgtagaccaaaagaaattcggtggtgataccccatacagcatcatgtttggacctgatatctgtgggtatgccacaaagaaggttcatgcaatcctcacttacaacggggaaaataagttgatcaagaaagatgttccttgtgaaaccgaccagctctcgcatgtttataccttcatcctccgccccgatgctacttacagtatcttaatcgataatgttgagaagcaaacaggaagcttgtacagtgattgggatcttctcccaccaaagcagattaaggaccccgaggccaaaaagcctgaagattgggatgagaaggagttcatccctgaccctgaagacaagaaacctgagggttatgatgacatcccaaaggagatcccagacccagatgccaaaaagccagaagattgggacgatgaggaagatggtgaatggactgtcccgactattccaaaccccgagtacaagggtccatggaaggcaaagaaaatcaagaacccgaactacaaagggaagtggaaggcacccatgatcgacaacccagattttaaggatgaccctgatctgtatgtcttccccaagttgaagtatgtcggcatagagctgtggcaggtgaaatctggcacattgttcgacaatgtcttgatctgcgatgaccctgaatacgccaaacaagtcgcagaagaaacatggggcaaacaaaaagatgctgagaaggcagcatttgaagagctagaaaagaagagggaagaggaggaaaccaaggatgacccagttgattctgatgttgaggataatgatgacgctgaggcagaagaagaggatgaggccgaagaaagtgacgtcaaggatgagctatagagaagaggggttggagtctgagagcagttagaatttgaagattttttttcttatttcaagacttctaatttggaaccctttttaatagatagataatgagaaatgtaatgcagaatttctgcccctcattttaattgctttcattggaaactattaaaaagaagtgggagtttgtgtgtttatgtaa

SEQ ID NO: 139 - protein, 409 aa, Helianthus argophyllus
MAIRRLNHKSLSFLSLLLLFSIASAKVFFEERFEDGWENKWVKSDWKKDENMAGEWNYTSGKWNGDANDKGIQTSEDYRFYAISAEYPEFSNKDKTLVFQFSVKHEQKLDCGGGYMKLLSGDVDQKKFGGDTPYSIMFGPDICGYATKKVHAILTYNGENKLIKKDVPCETDQLSHVYTFILRPDATYSILIDNVEKQTGSLYSDWDLLPPKQIKDPEAKKPEDWDEKEFIPDPEDKKPEGYDDIPKEIPDPDAKKPEDWDDEEDGEWTVPTIPNPEYKGPWKAKKIKNPNYKGKWKAPMIDNPDFKDDPDLYVFPKLKYVGIELWQVKSGTLFDNVLICDDPEYAKQVAEETWGKQKDAEKAAFEELEKKREEEETKDDPVDSDVEDNDDAEAEEEDEAEESDVKDEL

SEQ ID NO: 140 - DNA, 1747 bp, Hordeum vulgare
  misc_feature (1688)..(1688): n is a, c, g, or t
  misc_feature (1740)..(1741): n is a, c, g, or t
gaacagtggctcccccgggctgcaggctcgtgccgccatcggatcgggaaaaaagctcttgagtctcgactggtgtgtgcgagcgccgccgccgccgcccgagatggcgatccgccgtggctcctcctgcgccgtcctcgccctgctcgcgctcgcctccgtcgccgccgtcgccgccgacgtcttcttccaggagaagttcgaagatggctgggaaagccggtgggtcaagtctgagtggaagaaggacgagaacatggctggtgaatggaaccacacatctggaaaatggcatggagatgctgaggacaaaggtatccaaacctctgaggactacaggttctacgccatctctgcggagtaccctgagttcagcaacaaggacaagacactcgtgctgcagttcacggtgaagcatgagcagaagcttgactgcggtggtggttacgtcaagttgcttggaggtgatgttgaccagaagaaattcggtggcgacacaccctacggcattatgtttggacccgatatctgtgggtacagcaccaagaaggttcacactattcttaccaagaacggcaagaaccatttgatcaagaaggatgtgccttgcgagactgatcagctgtcgcatgtgtacactttgatcatccgccctgatgctacatacagcattctcattgacaatgaagagaagcaaactggaagcatctacgagcactgggatattcttcctcccaaggaaatcaaggacccagaagctaagaagccagaggactgggatgacaaggagtacattcctgatcctgaggacgtcaagccagagggctatgatgatattcccaaggaagtcactgaccctgatgctaagaagcctgaggattgggatgatgaggaagatggtgaatggactgccccaaccatccccaacccagagtacaagggcccatggaagcaaaaaaaaatcaagaaccctaactaccagggcaaatggaaggcacctatgattgccaacccagacttccaggatgatccttacatctacgcttttgacagcctgaagtacattggaatcgagctgtggcaggttaagtcaggaacgttgtttgacaacattctcatcactgacgatgctgctttggccaagacatttgccgaagagacctgggccaagcacaaggatgctgagaaggctgcttttgacgaggctgaaaagaagaaggaagaggaggatgcttccaaggccggtgaggacgatgatgacttggatgatgaggatgccgacgatgaggacaaggacgacaaggctgggtctgatgctgaggatgacaaggattctgatgatgagaagcacgatgagctctagatgacaaggaagagaggaggctgcctttgcctttgcgctgctgccaggatttattagttgtctcccattatgatgttccccttcttgtgatcagaaacttgacaagttactgtagtgtagaagaacaacatacaccgtgggatctttgtagcgcttttgtagttcgatttttacgggaagggaacttatagtcgttaaacgaggaaaaaaataagaaaaatcttgcagtagcctgtctgcatcttttcctttggtagtactcacatgctacgacttgccaaattagagacgccctcttgggctaatgatgcgttgcggcctgaanatcatgttcagacatgaaatataaccaggagcaacttaatgaacgtcaattnnacaagt

SEQ ID NO: 141 - protein, 419 aa, Hordeum vulgare
MAIRRGSSCAVLALLALASVAAVAADVFFQEKFEDGWESRWVKSEWKKDENMAGEWNHTSGKWHGDAEDKGIQTSEDYRFYAISAEYPEFSNKDKTLVLQFTVKHEQKLDCGGGYVKLLGGDVDQKKFGGDTPYGIMFGPDICGYSTKKVHTILTKNGKNHLIKKDVPCETDQLSHVYTLIIRPDATYSILIDNEEKQTGSIYEHWDILPPKEIKDPEAKKPEDWDDKEYIPDPEDVKPEGYDDIPKEVTDPDAKKPEDWDDEEDGEWTAPTIPNPEYKGPWKQKKIKNPNYQGKWKAPMIANPDFQDDPYIYAFDSLKYIGIELWQVKSGTLFDNILITDDAALAKTFAEETWAKHKDAEKAAFDEAEKKKEEEDASKAGEDDDDLDDEDADDEDKDDKAGSDAEDDKDSDDEKHDEL

SEQ ID NO: 142 - DNA, 1541 bp, Hordeum vulgare
ggttcggtgggcaggcccatcagaaggttccagaagcttcgggtggagtggtgggcacggtgacgatggcggtcctcgcgaggtcggccgccgccgtggtcgcgctcgcgctctcgctgctcgtgtcggccgccgccggcgaggtcttcttccaggagaagttcgacgatggatgggaggaccggtgggtcaagtcggagtggaagaaggaggacaacacggccggcgagtggaaccacacctcgggcaaatggaacggcgacgccgacgacaaaggcattcagacgtcggaggactacaggttctacgccatctcggcgcagtacccggagttcagcagcaaggacaagaccctggtgctgcagttctccgtcaagcacgagcaggacctcgactgcggcggcggctacgtcaagctgctccccgccgacgtcgaccagaacaagttcggcggcgagaccccatacagcatcatgttcgggccggacatctgtgggtacgccaccaagaaggtgcacgcgatcctcaccaagaacggcaagaacaacctgatcaagaaggaggtgccctgcgagacggaccagctcacgcacgtctacaccttgatcctccggcctgacgccacgtacagcatcctcatcgacaacgtcgagaagcagtccggcagcgtctacgacgactgggacattcttcctgccaagaagaagagggatcctgatgccaagaagccagaggactgggaagacgaggagtaccttcctgaccccgaggacaagaagccagaggggtatgatgacattcccgaggaaatcactgatcctgatgcaacgaagcctgaggactgggatgatgaggaagatggtgaatggacagctccaaccatcccaaaccctgagtacaagggaccatggatccagaagaaattcaagaaccctaatttcaagggcaaatggaaggcacctttgatcgacaacccagagtacaaggatgacccttacatttacgcctttgacagcctcaagcacattggcatcgagctgtggcaggttaaatcgggaactctattcgacaacatcctgatcactgatgaccccgagtacgccaagaagtttgcagaggagacctggggcaagcacaaggatgctgagaaggccgcctttgatgaggccgagaagaaaaggcttgaggaggaatccgcaaactctaatgccgaagacaacgatgacacggctgatgaggacgaggatgttgatggcaaagctgccggcgccagcgatgaggggaaggggcagcaggtgtctgcggatgagaaggtagaggaaattagcaaggatgcttcttcttctgacaagaaggatgagctttagagtgtggcaggcaggctctgtatctaagctttttccttgaggcagtagagcttccgaagaacattttctctgaaagatgagagaagtaatgcaatctcggctcttgtagtttgttatgtgtcttttgtcggtcatatgaaatggaaggaatatagcatagtcatggatcaaaaa

SEQ ID NO: 143 - protein, 433 aa, Hordeum vulgare
MAVLARSAAAVVALALSLLVSAAAGEVFFQEKFDDGWEDRWVKSEWKKEDNTAGEWNHTSGKWNGDADDKGIQTSEDYRFYAISAQYPEFSSKDKTLVLQFSVKHEQDLDCGGGYVKLLPADVDQNKFGGETPYSIMFGPDICGYATKKVHAILTKNGKNNLIKKEVPCETDQLTHVYTLILRPDATYSILIDNVEKQSGSVYDDWDILPAKKKRDPDAKKPEDWEDEEYLPDPEDKKPEGYDDIPEEITDPDATKPEDWDDEEDGEWTAPTIPNPEYKGPWIQKKFKNPNFKGKWKAPLIDNPEYKDDPYIYAFDSLKHIGIELWQVKSGTLFDNILITDDPEYAKKFAEETWGKHKDAEKAAFDEAEKKRLEEESANSNAEDNDDTADEDEDVDGKAAGASDEGKGQQVSADEKVEEISKDASSSDKKDEL

SEQ ID NO: 144 - DNA, 1647 bp, Ipomoea nil
aaagtatatttcgcgtatacaaatagggtctctctcagttcttcattgagtccattttctctcttcagccatggctgctcttagaagattaaattcggtgtttctctctctagccaagctatatctccttgttgctttcgtctccgcgggagtcatattcgaggagcgctttgacgatgggtgggagagtagatgggtcaagtctgactggaagaaggatgagaatatggctggggagtggaactacacctctggtaaatggaatggagaccctaacgacaaaggtattcagaccagtgaagactacaggttctatgccatctcagctgagttcccggagtttaataacaagggcaagaccctagttttccaattttcagttaagcatgagcaaaagcttgactgtggtggtggatacatgaaactgcttagtggtgacattgatcaaaagaaatttggcggtgacaccccttacagtatcatgtttggaccagacatctgtggctacagcaccaaaaaagtccatgctattcttacctataatgggacaaaccaattgatcaagaaggatgttccatgtgagactgaccagctaacccatgtctataccttcattctccgccctgatgctacatatagtattctcattgacaatgaggagaagcagtctggtagcttatacactgattggaatctgcttccaccaaagaaaattaaggatcctgaagccaagaaacctgaagattgggatgacaaggaatacattgatgatcctgaagataagaagccagagggttatgatgacatccccaaggagataccagatcttgatgctaagaagcctgaggattgggatgatgaagaggatggcgagtggactgccccaaccgttgccaaccctgagtacaagggtccatggacgccaaagaaaattaaaaaccccaactacaaggggaagtggaaggcacctatgattgataacccagacttcaaagatgatccagatctctatgttttcccaaatctgaagtatgttggcattgaattgtggcaggtgaaatctggtaccttgtttgacaatgttttggtaagtgatgatcccgagtatgcaaagaaattggctgaggagacatgggccaagaacaaggatggtgagaaggctgcatttgatgaggcagaaaagaagatagcagaggaggaatccaaggatgatccagctgactctgatgctgaggatgaagatgatgatgctgacgacacagatggtgatgatgctgactcaaaatccgaatcaaaacaagatgaaagcaagtctgagtccaaggaagatgatgcacatgatgaattgtgagggtccaaaatgctacggattactgctgctatccagacagctactttggcagttcatcactgaaaacttctttttgctatttttctctagattattttaggtttagttttcaatgtaaggaaacgatagtttgctatgtgagtcaagcctatggctgattgctttaatgataatgtgtctcggcctctgcaacaaacggaactttttttcttaactagggtcttaagtatactccgaatgcttttgattgcttaattcatggatttaattcccatgaaaatgatatttggactata

SEQ ID NO: 145 - protein, 426 aa, Ipomoea nil
MAALRRLNSVFLSLAKLYLLVAFVSAGVIFEERFDDGWESRWVKSDWKKDENMAGEWNYTSGKWNGDPNDKGIQTSEDYRFYAISAEFPEFNNKGKTLVFQFSVKHEQKLDCGGGYMKLLSGDIDQKKFGGDTPYSIMFGPDICGYSTKKVHAILTYNGTNQLIKKDVPCETDQLTHVYTFILRPDATYSILIDNEEKQSGSLYTDWNLLPPKKIKDPEAKKPEDWDDKEYIDDPEDKKPEGYDDIPKEIPDLDAKKPEDWDDEEDGEWTAPTVANPEYKGPWTPKKIKNPNYKGKWKAPMIDNPDFKDDPDLYVFPNLKYVGIELWQVKSGTLFDNVLVSDDPEYAKKLAEETWAKNKDGEKAAFDEAEKKIAEEESKDDPADSDAEDEDDDADDTDGDDADSKSESKQDESKSESKEDDAHDEL

SEQ ID NO: 146 - DNA, 1695 bp, Lotus japonicus
tggcgaagctctggagtatggtaacatgcttgtccaagagcaagagaatgtgaagagagtccagcttgcagacaagtacttgggcaagtagctctcgaattctctttctatctctagcaatggcgcttagggtgcgctctctcattcttctctgcctcttcgcgatcgcttccgccaaggtcttcttcgaagaacgcttcgatgatggatgggaaaatcggtgggtaaaatctgaatggaagaaggatgagagtttggctggggagtggaactacacctctggtcaatggaatggagatgccaatgacaaaggtattcaaacaagcgaagattatagattctatgctatctctgctgagttccctgaattcagcaacaaggataacacactagtgttccaattttctgtcaagcatgagcagaagcttgactgtggtggtggttacatgaagttgcttagcgacgatgttgatcagaagaaatttggtggagatactccttacagtatcatgtttggcccagatatctgtggttacactaccaagaaagtacacgctattctgacctacaatgggacaaaccacttgattaagaaggatgttccttgtgagactgatcaacttactcatgtttacacattcatcctccgtccagatgctacctacagcatcttgattgataatgtggagaagcaaactggtagtctctactctgattggagtcttctcccaccaaagaaaatcaaggatcctgaggccaagaagccagaagactgggatgacaaagagtacattcctgatcctgaagataagaaaccagaggggtatgatgacatcccagaatcgatcccagatactgatgccaagaagcctgaagattgggatgatgatgaagatggtgagtggacagcacctaccattgccaaccctgagtacaagggcccatggacgccaaagaaaattaagaaccctaactaccaaggaaagtggaaggcaccaacaattgacaacccagatttcaaggacgaccctgatctctatgtttaccccaaattgaagtatgttggcattgaattgtggcaggtcaaatctggtaccttgttcgacaatgtcttaattactgatgaccctgaatatgctaagcaagtggctgaagaaacatggggcaagcagaaggatgctgagaaagcagcatttgaagaggccgagaagaagagagaagaggaggaatctaaggaagatccagctgactctgatgccgaagatgaggaagataccgatgaagctagccatgactcagatgatgctgagtcaaagacggaagctggggaagacagtgctgatgccaatgaagaggatgtacatgatgagctctagagagtttgaaaagcggataccggagtgagcgaaagtcatattccggactctttttttactgtagtgattttttttctcctagataagtaagcagttgaaatctgtaagcaagaattcgagcttttgcttcatttcattcgactgttttcagtttattagaacagacaaaaatgtcacttttgaattgatcttttttagcgttttgatccatcgagttttcaactatgaagctagctgtgcctaaatcttatgaattgcttgacgattttctttgtagaacgtttgacatctaatatcctgaaaaatttcgcgagatcag

SEQ ID NO: 147 - protein, 418 aa, Lotus japonicus
MALRVRSLILLCLFAIASAKVFFEERFDDGWENRWVKSEWKKDESLAGEWNYTSGQWNGDANDKGIQTSEDYRFYAISAEFPEFSNKDNTLVFQFSVKHEQKLDCGGGYMKLLSDDVDQKKFGGDTPYSIMFGPDICGYTTKKVHAILTYNGTNHLIKKDVPCETDQLTHVYTFILRPDATYSILIDNVEKQTGSLYSDWSLLPPKKIKDPEAKKPEDWDDKEYIPDPEDKKPEGYDDIPESIPDTDAKKPEDWDDDEDGEWTAPTIANPEYKGPWTPKKIKNPNYQGKWKAPTIDNPDFKDDPDLYVYPKLKYVGIELWQVKSGTLFDNVLITDDPEYAKQVAEETWGKQKDAEKAAFEEAEKKREEEESKEDPADSDAEDEEDTDEASHDSDDAESKTEAGEDSADANEEDVHDEL

SEQ ID NO: 148 - DNA, 1418 bp, Lactuca serriola
gacacacactctgtgtagcgatggcgaatcggaggttaaaccctacttctctagcctttctagctctacttctgctcttctcgatcgcttctgctaaagtgttctttgaggagcgcttcgatgatggatgggaaagcaggtgggtaaaatctgactggaagaaagatgagaacatggctggggagtggaattacacttctggtaaatggaatggagatgccaatgataaaggtatccaaaccagtgaagactacaggttttatgcaatttcagctgagtaccctgaattcagcaacaaggataaaactttagtcttccagttttctgttaagcatgaacagaagctcgattgtggtggtggctacatgaaattgctgagtggtgatgttgatcaaaagaaatttggtggtgataccccatacagcatcatgtttggacctgatatttgtgggtatgcaacaaagaaggttcatgcaattctcacatacaatggagaaaacaaattgatcaagaaagatgttccttgtgaaactgatcaactttcacatgtttatacctttgtccttcgccctgatgccacctacaccatctcaattgataatgttgagaaacaaacaggaagtttgtactctgattgggatcttcttccagcaaaacagataaaggaccctgaggccaaaaagcctgaagattgggatgagaaggaattcatccctgaccctgaagacaagaagcctgatggttatgatgacatcccaaaggagatttcagaccctgatgccaagaagccagaggattgggatgatgaggaagatggtgagtggactgttccaactattccaaaccctgattacaagggtccatggaaggcaaagaaaatcaagaaccccaactacaaaggaaagtggaaggcacccatgattgacaacccagattttaaagatgacccagatctctatgttttccccaagttgaagtatgttggtattgagttgtggcaggttaaatctggaactctttttgacaatgtcttgatatgtgatgatcctgaatatgccaaacaagtggctgaacaaacatggggaaaacaaaaagatgctgaaaaggcagcatttgaagagctagaaaagaaaaaggaggaagaggaatcaaaggatgatcctgctgattctgatgctgataatgatgatgctgaaccagaagatgaggaagaggctgatgaaaatgatgttaaggatgagctatagaagaggctttcagcagttagagtttaagattttttttttttctattttacttttaagttgagtttctaggacttttttttaatagagattataaacaactggaaatgtaatgcagatgagattttctgaaccctgaattgagaattccattggtctctatttactacagga

SEQ ID NO: 149 - protein, 408 aa, Lactuca serriola
MANRRLNPTSLAFLALLLLFSIASAKVFFEERFDDGWESRWVKSDWKKDENMAGEWNYTSGKWNGDANDKGIQTSEDYRFYAISAEYPEFSNKDKTLVFQFSVKHEQKLDCGGGYMKLLSGDVDQKKFGGDTPYSIMFGPDICGYATKKVHAILTYNGENKLIKKDVPCETDQLSHVYTFVLRPDATYTISIDNVEKQTGSLYSDWDLLPAKQIKDPEAKKPEDWDEKEFIPDPEDKKPDGYDDIPKEISDPDAKKPEDWDDEEDGEWTVPTIPNPDYKGPWKAKKIKNPNYKGKWKAPMIDNPDFKDDPDLYVFPKLKYVGIELWQVKSGTLFDNVLICDDPEYAKQVAEQTWGKQKDAEKAAFEELEKKKEEEESKDDPADSDADNDDAEPEDEEEADENDVKDEL

SEQ ID NO: 150 - DNA, 1570 bp, Malus domestica
gtagctgcagactttctcagtggcgaaaacgatggcgtttagggttcgaaacagctcgagcttgctgtccctggtccttctctctctcctcgccatcgcctccgccaaggttttcttcgaagagcgcttcgaagatggatgggacaaacgttgggtgaaatctgactggaagagagaagagggccttgccggagaatggaactacacctctggaaaatggaatggagatgctaatgacaaaggtatccaaacaagtgaggactataggttttatgccatttcagctgagttccctgaattcagcaacaaggacaagacactagtgttccaattttccgtgaaacatgagcagaagcttgactgtggtggtggctatatcaagttactcagtggtgacgttgatcagaagaaattcggcggtgataccccatacagtatcatgtttgggccagatatctgtggatacaccaccaagaaagttcacgcaatccttaactacaatgacacaaataaattgatcaagaaggacgtcccctgtgagactgaccaactcactcatgtttatactttcatcctccgcccagatgctacctacagcatccttatcgacaatgtagagaaacaaactggtagcctatacagtgattgggatcttctgccaccgaagaagatcaaggatcctgaggccaagaaacctgaagattgggaagataaagaatacattcctgaccctgaagatgctaagccagagggttatgatgacattcccaaggagataaccgatcccgatgccaagaagccggaagattgggatgatgaggaagatggtgaatggactgccccaaccattcccaaccctgaatacaagggtgaatggaagccaaagaaaatcaagaaccccaacttcaagggaaagtggaaggcaccactgattgacaacccagagttcaaggatgaccctgagctgtatgtttaccccaacttgaagtatgttggaattgaattgtggcaggtgaaatctggaaccctgtttgacaatatcttgatcactgatgagccggagtatgcaaagcaactggctgaggaaacatggggcaaacaaaaagatgccgagaaggcagcatttgaagaggcagagaaaaagcaggaggaggaagcaaaagatccagttgactctgatgctgaggaagaggatgatgctgacacagatgatgctgaagatgactctgatgcggaatctaaatcggactcaactgaagagagcgccgaggagtctgagaaacatgatgaactgtaggaagggaagcatctagagaaagcttcggcgagtgcgccattttttctccttattttttagctgtagaagtgttaagagggaagagatactgctaaatgttgaatgttgctgatgtcttaatctctcatgggaacaaaaacgatgacattgtgtttttcataatcacatgagaatagtttaaacaagtcgccgttgaatttcttctttcggatcagtatttcgtgttatattttcgcttcaatgctaaaaatggtccttgtgttttaaaaaaaa

SEQ ID NO: 151 - protein, 421 aa, Malus domestica
MAFRVRNSSSLLSLVLLSLLAIASAKVFFEERFEDGWDKRWVKSDWKREEGLAGEWNYTSGKWNGDANDKGIQTSEDYRFYAISAEFPEFSNKDKTLVFQFSVKHEQKLDCGGGYIKLLSGDVDQKKFGGDTPYSIMFGPDICGYTTKKVHAILNYNDTNKLIKKDVPCETDQLTHVYTFILRPDATYSILIDNVEKQTGSLYSDWDLLPPKKIKDPEAKKPEDWEDKEYIPDPEDAKPEGYDDIPKEITDPDAKKPEDWDDEEDGEWTAPTIPNPEYKGEWKPKKIKNPNFKGKWKAPLIDNPEFKDDPELYVYPNLKYVGIELWQVKSGTLFDNILITDEPEYAKQLAEETWGKQKDAEKAAFEEAEKKQEEEAKDPVDSDAEEEDDADTDDAEDDSDAESKSDSTEESAEESEKHDEL

SEQ ID NO: 152 - DNA, 1272 bp, Medicago truncatula
atggcgattagggttcgaaaccctaaccttctttctctcgttcttttctcccttctctccatcgcttctgcgaaggttttcttcgaagaacgcttccaagatggatgggaaagccggtgggtaaaatccgaatggaagaaagacgagaacttggctggggagtggaactacacctctggtcaatggaatggagacgctaatgacaaaggtattcaaaccagtgaagattacagattttatgctatctctgccgagttccctgaattcagcaataaggataacacactagtcttccaattttctgtcaagcatgaacagaaacttgactgtggtggtggttacatgaagttgcttagcggcgatgttgatcagaagaattttggcggtgatactccttacagtatcatgtttggtccagatatctgtggttacagcaccaagaaagtacacgctattctgacctacaatgacacaaaccacttaatcaagaaggatgttccttgtgagactgaccagcttactcatgtttacacattcatcatccgtcctgatgcaacctacagcattttgattgataatgtggagaagcaaacaggtagtctctactctgactggagtcttctcccaccaaagaaaatcaaggaccctgaggccaaaaagccagaggattgggatgataaggagtttattcctgatcccgaagacaagaagccagagggatatgatgacatccctaaagaggtcgcagatcctgatgccaaaaagcctgaggactgggatgacgaggaagatggtgagtggaccgcacctaccattgccaacccagagtacaagggaccatggaagccaaagaaaatcaagaaccccaactacagtggaaagtggaaggcaccattgattgacaacccagacttcaaggacgaccctgacatctatgttttccccaagttgaagtatgttggcattgaattgtggcaggtgaaatctggtacattgtttgacaatgttgttattaccgatgatcctgagtatgctaagcaagttgctgaagaaacatggggcaagcagaaagatgctgagaaggcagcatttgaagaggctgagaagaagaaagaggaggaggaaacaaaggatgatccagttgattctgatgcggaagaggatgaagaagatgccaatgaagttagccacgactctgatgatgagtcaaaggcggaagctggcgaagacagcgatgaaaccaataaagatgacgtacatgatgagctctag

SEQ ID NO: 153 - protein, 423 aa, Medicago truncatula
MAIRVRNPNLLSLVLFSLLSIASAKVFFEERFQDGWESRWVKSEWKKDENLAGEWNYTSGQWNGDANDKGIQTSEDYRFYAISAEFPEFSNKDNTLVFQFSVKHEQKLDCGGGYMKLLSGDVDQKNFGGDTPYSIMFGPDICGYSTKKVHAILTYNDTNHLIKKDVPCETDQLTHVYTFIIRPDATYSILIDNVEKQTGSLYSDWSLLPPKKIKDPEAKKPEDWDDKEFIPDPEDKKPEGYDDIPKEVADPDAKKPEDWDDEEDGEWTAPTIANPEYKGPWKPKKIKNPNYSGKWKAPLIDNPDFKDDPDIYVFPKLKYVGIELWQVKSGTLFDNVVITDDPEYAKQVAEETWGKQKDAEKAAFEEAEKKKEEEETKDDPVDSDAEEDEEDANEVSHDSDDESKAEAGEDSDETNKDDVHDEL

SEQ ID NO: 154 - DNA, 1939 bp, Ocimum basilicum
gaaagattttctatactaatgatcaaacaaagtatacttttctatattaatgaaaagagaagaaaagatacatagcattatgtattattctcaactgaaaagctgtaacttcgatatttcaaatctccaagggatcaagaagcaccatcttcacccattctttagatttgatggggttcgcatagcaatcgtcgtctgcatacaaaagatttatgacacgaccaagattgacgacgcgcatcaggatttgcatggaggccggtcttggttctagacattcttgattcatatccttccatgcattcttcacttgctttcgaagctcatcacgagcttcatcctttgacacaccgtattgtttcatatagcaatgaatagacgaggtcttctgctcatactcatctcccaccaagtcatccattactcggcagccatggcgatagtacagagaagatcgctgatcacaactcttctatctgtagcgttgactctctccctccttctagctgttgcctctgccgctgtattctttgaggagcgatttgatgatggatgggaaagtcggtgggtgaaatctgactggaagaaagatgagaacatggctggagagtggaattacacctccgggaagtggaacggaaaccctgatgacaaaggtatccagaccagtgaagactacagattctatgccatctctgctgaattccctgaatttagcaacaaggataagaccctagttttccaattttctgtcaagcacgagcagaaactcgactgtggtggtggatacatgaaattgctcagtggtgatattgaccagaagaaatttggtggtgacactccatacagcatcatgtttgggccagacatctgtggatacaccaccaaaaaggttcatgctattcttacatacaacgggacaaacaacttgatcaagaaggatgttccatgtgagactgaccaactgtctcatgtgtatactttcatcctcaaacctgatgcaacctacacaattctcattgacaatgtggagaagcagtcagggagcttgtactctgactgggatctattgcctccaaagcagatcaaggacccagaggccaagaagcctgaagattgggatgatagggaaaatattcctgatcctgaggacaagaagccagagggttatgatgatatcccgaaggaaattcctgattctgaggccaaaaagcctgaggactgggatgatgaggaagatggtgaatggactgctccaaccattcccaaccccgagtacaaggggccatggaaggcaaagaaaattaagaaccccaactacaagggcaagtggaaggcaccattgattgataacccagagttcaaggatgacccagaactatatgttttcccgaagttgaagtatgtaggcatcgagttgtggcaggtgaaatctggaactttgtttgacaatgtccttatagccgatgaccctgaatatgcgaagaaggtagcagaagaaacatggggcaagcaaaaggatgctgagaaagctgctttcgaagaagccgaaaagaagagagaggaggaggaatcaaagaatgatggagttgattcagatgctgatgatggagaggagtctgatgctgaagctgatgacgccgatgattccaagatagacccgaacgaagaccctgtagcctctgtcgatgacgacgtgcatgacgaattgtagggtatggcaagggatgagtggtgtaatttcttataggctttactggccaagatttttcttattagttatagttctttctatggataaacaatgagaattgtaactggacgatgacaacatttgtggctgattgcttttaactgagtctgtttctagaacagtttttttggctcatcatagtctgaaattttgacgttgttctattaatgtcaatgtataatctca

SEQ ID NO: 155 - protein, 447 aa, Ocimum basilicum
MNRRGLLLILISHQVIHYSAAMAIVQRRSLITTLLSVALTLSLLLAVASAAVFFEERFDDGWESRWVKSDWKKDENMAGEWNYTSGKWNGNPDDKGIQTSEDYRFYAISAEFPEFSNKDKTLVFQFSVKHEQKLDCGGGYMKLLSGDIDQKKFGGDTPYSIMFGPDICGYTTKKVHAILTYNGTNNLIKKDVPCETDQLSHVYTFILKPDATYTILIDNVEKQSGSLYSDWDLLPPKQIKDPEAKKPEDWDDRENIPDPEDKKPEGYDDIPKEIPDSEAKKPEDWDDEEDGEWTAPTIPNPEYKGPWKAKKIKNPNYKGKWKAPLIDNPEFKDDPELYVFPKLKYVGIELWQVKSGTLFDNVLIADDPEYAKKVAEETWGKQKDAEKAAFEEAEKKREEEESKNDGVDSDADDGEESDAEADDADDSKIDPNEDPVASVDDDVHDEL

SEQ ID NO: 156 - DNA, 1779 bp, Oryza sativa
attttctcaggtggttttctggttcagtggagaaaaaaaaaggttagaattagacttctttggaaggttctagaggtttctagataccgccgtcccggggggtgatggcgatccccagaaggtcggcggccgccgtcgctgccgtggtggcgctcgcgtccgtggccgctgtcgccggcgaggtcttcttccaggagaagttcgacgatggatgggaggatcggtgggtcaaatctgagtggaagaaggatgacaacagggccggcgaatggaaccacacctccggcaagtggtacggcgacgccgacgacaagggtatccagacgtcagaggactacagattctacgccatttcggccaagtaccctgagttcagcagcaaggacaagaccctcgtgctgcagttctcggtgaagcacgagcagaagctcgactgcggcggcggctacgtgaaattgctcggtggcgacgttgaccagaagaagtttggtggcgagacgccgtacagcatcatgtttggaccagatatctgcgggtatgccaccaagaaggttcacgctatccttacaaagaacggcaagaaccatctaatcaagaaggacgtgccatgcaagaccgatcaactgacgcacgtctacaccttgatcatccgtcctgacgccaaatacagcattctgatcgataacactgagaagcaaactggaagcatctatgatgattggaacattattcctccaaagaataagagggatcctgaagccaagaagccagaagactgggacgacaatgaatacattcctgatcctgaggacaagaagcctgagggctatgatgatatccctaaggaaattactgacccagaagcaactaagcctgaggactgggatgatgaggaagatggagaatggacagctccaaccattccaaaccctgagtacaagggaccatggaaccaaaagaaacttaagaaccctaattacaagggcaaatggaaggcaccattgatccccaacccagattacaaggatgatccttacatctacgcttttgatagtttgaaccacattggcattgagctgtggcaggttaagtcgggaactttgtttgacaacattcttatcactgatgaccctgagtatgccaagaaatttgcagaagaaacctgggccaagcataaagatgctgagaaagccgcctttgatgaagctgagaagaagaggcttgaggaggaatctgcaaactctaaaatcgacgacagcgacgacgacgctagtgatgatgaggatgaggcggacgatgacaaggctgatgtcgttgctgagcagaccaaggacaagggtgatgagaaaccgcaggacatcaaggtctctgctgatgagaagccaaagagcagcaaggatgattcttccgctgcgaagaaggacgagctttagatattttattattattagatgataatatgtcatgacgaagaggcaactgaatcaggtgttggtgctaaatatttcctaagcaggggatcagagaagaggagcagagaagcttgtgctagttttaactggtttctttacttgcttgcttgagggctgaacagtacacttgcttgtacgttgggcagcacaccatcatcagtctatacacatgcactggctttctatttataggcttgataaaccgatatgtaagaagcttcaggacctagctagagacttgtagtactactacattgtcaaacttcactggtactagtactactgtaaaatcacatcatgcatgtct

SEQ ID NO: 157 - protein, 442 aa, Oryza sativa
MAIPRRSAAAVAAVVALASVAAVAGEVFFQEKFDDGWEDRWVKSEWKKDDNRAGEWNHTSGKWYGDADDKGIQTSEDYRFYAISAKYPEFSSKDKTLVLQFSVKHEQKLDCGGGYVKLLGGDVDQKKFGGETPYSIMFGPDICGYATKKVHAILTKNGKNHLIKKDVPCKTDQLTHVYTLIIRPDAKYSILIDNTEKQTGSIYDDWNIIPPKNKRDPEAKKPEDWDDNEYIPDPEDKKPEGYDDIPKEITDPEATKPEDWDDEEDGEWTAPTIPNPEYKGPWNQKKLKNPNYKGKWKAPLIPNPDYKDDPYIYAFDSLNHIGIELWQVKSGTLFDNILITDDPEYAKKFAEETWAKHKDAEKAAFDEAEKKRLEEESANSKIDDSDDDASDDEDEADDDKADVVAEQTKDKGDEKPQDIKVSADEKPKSSKDDSSAAKKDEL

SEQ ID NO: 158 - DNA, 1584 bp, Oryza sativa
aagccaaggccgcgcttccgccgctgcagccgatacgggagattggatcggaagcttctagaagtttccgtgggcgatggcgatccgcgcgaggtcctcctcctacgccgccgcggcggtcgcgctggcgctcgcgctggcgtccgtcgccgctgtcgccggcgaggtcttcttccaggagaagttcgaagatggatgggaaagtcggtgggtcaagtcagaatggaagaaggatgagaacatggctggtgaatggaaccacacatctgggaagtggaatggagatcctgaggacaaaggtatccaaacctctgaggactacaggttctacgctatttcagcggagtacccagaattcagcaacaaggataaaaccctggtgctgcagttctctgtaaagcatgagcaaaagcttgactgtggtggtggatatgtcaagttgcttggtggtgatgttgaccagaagaaatttggtggggacacaccgtacagcattatgtttggaccagacatctgtgggtacagcaccaagaaggtccatactatctttactaagaatgacaagaaccatttgatcaagaaggatgtcccctgcgagactgatcagctgtcccatgtgtacactttgatcatccatcctgatgctacatacaccatacttattgacaatgttgagaagcaatctggcagcatctacgagcactgggatattctgcctccgaagcaaatcaaggacccagaagctaagaagccagaggactgggatgacaaggagtacattcctgaccctgaggacaagaagcctgagggatacgatgatattcccaaggaaatccctgaccctgatgctaagaagcctgaggactgggatgatgaggaagatggtgagtggactgcaccaaccattcctaaccctgagtacaagggaccatggaagcaaaagaaaatcaagaaccctaactaccaaggcaaatggaaggcaccgatgatcgacaacccagacttcaaggatgatccatacatctatgcttttgacagcctgaagtacattggcattgagttgtggcaggtcaaatcaggtactctgtttgacaacttccttattactgacgaccctgagttggccaagacattcgcagaggagacatggggcaagcacaaggatgctgagaaggctgcttttgacgaggcagagaaaaagaaggaagaggaggaagctgccaaggccggtgaggacgatgatgatttggatgacgaggatgctgaggatgaggacaaggccgatgagaaggctgactctgatgcagaggatggcaaggattctgatgatgagaagcatgatgagctctaagatggtgaggatgaagaatggaggccgccttcgcgacgatgccaggatttgctagttctcccattgttatgaagttccctttttcgtgatcagaaacttgacaagaaagtactctgtagatgagcattgctgaggaactttaatttggtctttgtagctctctctgtagtgtcatttttcccaccacaagaaaaagaactgataacttattgaacaagagaaatcttttgcac

SEQ ID NO: 159 - protein, 424 aa, Oryza sativa
MAIRARSSSYAAAAVALALALASVAAVAGEVFFQEKFEDGWESRWVKSEWKKDENMAGEWNHTSGKWNGDPEDKGIQTSEDYRFYAISAEYPEFSNKDKTLVLQFSVKHEQKLDCGGGYVKLLGGDVDQKKFGGDTPYSIMFGPDICGYSTKKVHTIFTKNDKNHLIKKDVPCETDQLSHVYTLIIHPDATYTILIDNVEKQSGSIYEHWDILPPKQIKDPEAKKPEDWDDKEYIPDPEDKKPEGYDDIPKEIPDPDAKKPEDWDDEEDGEWTAPTIPNPEYKGPWKQKKIKNPNYQGKWKAPMIDNPDFKDDPYIYAFDSLKYIGIELWQVKSGTLFDNFLITDDPELAKTFAEETWGKHKDAEKAAFDEAEKKKEEEEAAKAGEDDDDLDDEDAEDEDKADEKADSDAEDGKDSDDEKHDEL

SEQ ID NO: 160 - DNA, 1556 bp, Prunus persica
gctctctcatcacactcggtagctctgcaactctcagtgggtgaaaacgatggcgtttagggttccaaactctagcttgctgtccctgatcctcctctctctcctagctatcgcctccgccaaggtcttcttcgaagaacgcttcgaggacggatgggataaacgttgggttacttccgagtggaagaaagaggagaacctggctggtgaatggaactacacctctggaaaatggaatggagaccctaatgacaaaggtatccaaacaagtgaggactacaggttctatgccatatcagctgagttccctgaattcagcaacaaggataagacactcgtgtttcaattttctgtgaagcatgagcagaaacttgactgtggtggtggctacatcaagctactcagtggtgatgttgatcagaagaaatttggcggtgataccccatacagtatcatgtttgggccagatatctgcggatacagcaccaagaaagtgcatgcaattcttaactacaataatacaaataacttgatcaagaaggatgttccttgtgagactgaccaactcactcatgtctatacttttatcatccgtccagatgctacctacaccatccttattgacaatgctgagaaacaaactggtagcctctacagcgattgggatcttctgcctgcaaagaaaatcaaggatcccgaggccaagaaacctgaagattgggaagaccaagaatacatccctgaccctgaagataagaagccagaggggtatgatgacattcccaaggaaatagccgattccgatgccaagaagcctgaagactgggatgatgaggaagatggtgaatggactgccccaaccattcccaaccctgagtacaagggtgaatggaagccaaagaaaatcaagaaccccaacttcaagggaaagtggaaggcaccattgattgacaacccagaattcaaggatgaccctgagctgtatgtttaccccaacttgaagtacgtcggaatcgaattgtggcaggtgaaatctggaaccctgtttgacaacattttgatcactgatgagccggagtatgcaaagcagttggctgaggaaacatggggcaaacagaaagatgccgagaaggcagcattcgaggagctggagaagaagctgcaggaggaggaatcaaaagaagacccagttgattctgatgccgaggacgatgatgctgacgccgaagatggagaagaatctgattccgaatcgaaaccagactcaactgaagagagtgccgaaactgaggctgagaaacatgatgaactgtagggagggagcaccgcaaagttctagagataagcttgggatgttttttcgtcttattttttagctgtagaacctcttagagggaacagatattgctaaaagttgcatgccaaactgctttagctgctgatgtcttaatcttatttagctgtttgagccatgggaacaaattgatgagatgtgtttttcataatcgcattcatgagcatagtttaaacaagtttttttgaatacctttaaattc

SEQ ID NO: 161 - protein, 421 aa, Prunus persica
MAFRVPNSSLLSLILLSLLAIASAKVFFEERFEDGWDKRWVTSEWKKEENLAGEWNYTSGKWNGDPNDKGIQTSEDYRFYAISAEFPEFSNKDKTLVFQFSVKHEQKLDCGGGYIKLLSGDVDQKKFGGDTPYSIMFGPDICGYSTKKVHAILNYNNTNNLIKKDVPCETDQLTHVYTFIIRPDATYTILIDNAEKQTGSLYSDWDLLPAKKIKDPEAKKPEDWEDQEYIPDPEDKKPEGYDDIPKEIADSDAKKPEDWDDEEDGEWTAPTIPNPEYKGEWKPKKIKNPNFKGKWKAPLIDNPEFKDDPELYVYPNLKYVGIELWQVKSGTLFDNILITDEPEYAKQLAEETWGKQKDAEKAAFEELEKKLQEEESKEDPVDSDAEDDDADAEDGEESDSESKPDSTEESAETEAEKHDEL

SEQ ID NO: 162 - DNA, 1463 bp, Pinus pinaster
  misc_feature (1433)..(1433): n is a, c, g, or t
taaccattgaaaatggcaggccgacgatcgcttttgtacgctgtgttgctgctgctgttcgttactttcgtctccgccgaagtctttttcgaggagcgtttcgatgatagctgggaaagtcgttgggtgcaatctgattggaaaaaggatgaaagcttggctggagattgggtgcacacagcagggaaatggaacggggatccaaatgacaagggcatccaaacacatacagactatagattttttgccatctcagctgcgtaccctgaatttagcaacaaggataaaacccttgttcttcagttttctgtcaagcatgaacaaaaacttgattgtggtggtggctatgtaaagttgttaagtggtgaagttgaccagaagaatttcagtggagagacaccttatagtattatgtttggaccagacatttgcggttacagcactaagaaggttcataccattctgtcatataaagggaagaaccatcctatcaaaaaagatgtcccttgtgaaacagatcagcttactcatgtttatacattcattcttcgaccggatgctacatatagcatcctcattgacaacaaggacaaacagtctgggagtttgtacaaggattgggacttgttgccatcaaaaacaatcaaggaccctaatgccaaaaagcctgaggattgggatgataaggaatacattcctgatccagaagacaagaaacctgagggatatgatgacattccaaaggaaatacctgatccagatgccactaagccagaggattggaatgacgaggaggatggtgagtggacagctccaactattgcaaatccagaatataaaggaccgtggaatcctaagaaaattaagaatcctaactacaagggtaaatggaaggctccaataattgacaatcctgatttcaaggatgatccagagctctatgtttttcccaatctcaaatatctaggaatcgagttatggcaggtcaagtcaggaacattatttgataacattttaatctctgatgatcctgaatatgccaagaagttagcagaggaaacatgggccaaacacaaggatgccgaaaaggaagcctttgacgaggcagagaaaaagaaagaagaggaggagaaagagaaagagcctgatgatgaggatacagatgaggaggaggaaaaatctgatgacgaggatgcagatgaattagacaatgaacacaaagaagcagacaagaaagaacatgaattagacagtgaacacaaagaagaggacaagaaagaacatgatgagctatagttgcttaatatatgcaacgctgctttcatgtgggatggtaccatgaattggaaatttggagtcattgttttatcctctcaaattttgcaagggtttacagatggtttctttgatgaatgcttgttttgaaacggctntacagaaaggagtaataattattgtagtct

SEQ ID NO: 163 - protein, 427 aa, Pinus pinaster
MAGRRSLLYAVLLLLFVTFVSAEVFFEERFDDSWESRWVQSDWKKDESLAGDWVHTAGKWNGDPNDKGIQTHTDYRFFAISAAYPEFSNKDKTLVLQFSVKHEQKLDCGGGYVKLLSGEVDQKNFSGETPYSIMFGPDICGYSTKKVHTILSYKGKNHPIKKDVPCETDQLTHVYTFILRPDATYSILIDNKDKQSGSLYKDWDLLPSKTIKDPNAKKPEDWDDKEYIPDPEDKKPEGYDDIPKEIPDPDATKPEDWNDEEDGEWTAPTIANPEYKGPWNPKKIKNPNYKGKWKAPIIDNPDFKDDPELYVFPNLKYLGIELWQVKSGTLFDNILISDDPEYAKKLAEETWAKHKDAEKEAFDEAEKKKEEEEKEKEPDDEDTDEEEEKSDDEDADELDNEHKEADKKEHELDSEHKEEDKKEHDEL

SEQ ID NO: 164 - DNA, 1489 bp, Picea sitchensis
tcccttgaacccaaacccttgacaatggcgtctggaggattagtcaagctgggcctcctgctcatctgctttgcttcgatatcctccgctcatgtttacctcgacgaacgattcgacgatggatgggaaaatcgttgggtgatatccgattggaagaaggatgaaggcgcagcaggggagtggctgcacactgctggaaaatggaatggggaccccgatgacaaagggattcaaactcatccagatgcacgtttctttgccatttctgctgagtttccggagttcaacaacaaggataagacacttgttcttcaattttctgtcaagcatgagcagaaacttgattgtggtggtggatatgtgaagcttttgagtggtgatgttgaccaaaagaagtttggtggagatacaccttacagtatcatgtttggtccagatatatgtggttatagtacaaagaaggttcatgccattcttggtcacggtggaaagaaccttcctatcaaaaaggatgtatcatgtgaaacggatcagcttactcatgtttatactttcattcttcaccctgatgctacctacagcattctcattgacaacaaggagaaagattctggaagtttatacaccgattgggatattttaccaccaaaacaaattaaggatcctaatgccaaaaagccagaagactgggaagataaagaatacattcctgatccagaagacaaaaagcctgagggatatgatgacattccagaggaaattccagactcagatgccactaagccagaggactgggatgatgaagaggatggtgagtggaaagctccaaccattccaaatccagagtacaaaggaccatggaagccaaagaaaatcaagaatctaaagtacaagggaaaatgggttgcaccaatgatagacaatccagatttcaaggatgatccagaactctatgttttccccagtctgaaatacttagggatcgaattatggcaggttaaatcaggaacattatttgataacattttagtatctgatgatcctgaatatgcgaagaaggtggcagaggagacatggggaaaacacaaggatgctgaaaaggaagcttttgaagcggaagagaaaaagaacgatgaggaggaatctaaggatgaggaggatgaggatacaactgatgagactgaagagccggaagaagaggaggataatgaagagcatgatgagttgtaggcgatacacattagctggaagtcagttggggtagaggtgctaacaacaattcaaattctgttactagcttagggagaaattataacatgttgctcaattgtattggatgtccaaaatattttggaacagactgaagttgatttatatcaggtctcttttgaaagggggcctggttcgaatgaatttgttaacctgcataagaaacatgcatctctgagaaattttcaatagaaataatttgggaagctatttgatattc

SEQ ID NO: 165 - protein, 401 aa, Picea sitchensis
MASGGLVKLGLLLICFASISSAHVYLDERFDDGWENRWVISDWKKDEGAAGEWLHTAGKWNGDPDDKGIQTHPDARFFAISAEFPEFNNKDKTLVLQFSVKHEQKLDCGGGYVKLLSGDVDQKKFGGDTPYSIMFGPDICGYSTKKVHAILGHGGKNLPIKKDVSCETDQLTHVYTFILHPDATYSILIDNKEKDSGSLYTDWDILPPKQIKDPNAKKPEDWEDKEYIPDPEDKKPEGYDDIPEEIPDSDATKPEDWDDEEDGEWKAPTIPNPEYKGPWKPKKIKNLKYKGKWVAPMIDNPDFKDDPELYVFPSLKYLGIELWQVKSGTLFDNILVSDDPEYAKKVAEETWGKHKDAEKEAFEAEEKKNDEEESKDEEDEDTTDETEEPEEEEDNEEHDEL

SEQ ID NO: 166 - DNA, 1610 bp, Pinus taeda
cggccgggggcagtagtggtgtggtaaccattgaaaatggcaggccgacgaacgcttttgtacgctgtgttcttgctgctgttcgttactctcgtctcagccgaagtctttttcgaggagcgtttcgatgatagctgggaaagtcgttgggtgcaatctgattggaaaaaggatgaaagcttggctggagattgggtgcacacagcagggaaatggaacggggatccaaatgacaagggcatccaaacacatacagactatagattttttgccatctcagctgcgtaccctgagtttagcaacaaggataagacccttgttcttcagttttctgtcaagcatgaacaaaaacttgattgtggtggtggctacgtaaagttgttaagtggtgaaattgaccagaagaatttcagtggagagacaccgtatagtattatgtttggaccagacatttgcggttacagcactaagaaggttcataccattctgtcatataaagggaagaaccatcctatcaaaaaagatgtcccttgtgaaacagatcagcttactcatgtttatactttcattcttcgaccggatgctacatatagcatcctcattgacaacacggacaaacagtctgggagtttgtacaaggattgggacttgttgccaccaaaaacaatcaaggaccctaatgccaaaaagcctgaggattgggatgataaggaatatattcctgatccagaagacaagaaacctgagggatatgatgacattccaaaggaaatacctgatccagatgccactaagcccgaggattggaatgacgaggaggatggtgagtggacagctccaactattgcaaatccagaatataaaggaccctggaagcctaagaaaattaagaatcctaactacaagggtaaatggaaggctccaatgattgacaatcctgatttcaaggatgatccagagctctatgtttttcccaatctcaaatatctaggaatcgagttatggcaggtcaagtcaggaacattatttgataacattttaatctctgatgatcctgaatatgccaagaagttagcagaggaaacatgggccaaacacaaggatgccgaaaaggaagcctttgatgaggcagagaaaaagaaagaagaggaggagaaagagaaagagtctgatgatgaggaggatacagatgaaaaggaggaaaaatctgatgacgaggatgcagatgaattagacgatgaacacaaagaagcagacaagaaagaacatgaattagacagtgaacacaaagaagaggacaagaaagaacatgatgagctatagttgcttaatatatgcaacactgctttcatgtgggatggtaccatgaattggaaatttggagtcattgttttatcctctcaaattttgcaagagtttacaggtggtttctttgatgaatgcttgttttgaaacggctttacagaaaggagtaataattattgtagtctccctttttaatggtgagcaacattttttaaggactcttgcaagaaatgcttttattttcgaacagtgggcaggtttacccggcaagtagtcaatgaaaaataataaaactttcattttgc

SEQ ID NO: 167 - protein, 428 aa, Pinus taeda
MAGRRTLLYAVFLLLFVTLVSAEVFFEERFDDSWESRWVQSDWKKDESLAGDWVHTAGKWNGDPNDKGIQTHTDYRFFAISAAYPEFSNKDKTLVLQFSVKHEQKLDCGGGYVKLLSGEIDQKNFSGETPYSIMFGPDICGYSTKKVHTILSYKGKNHPIKKDVPCETDQLTHVYTFILRPDATYSILIDNTDKQSGSLYKDWDLLPPKTIKDPNAKKPEDWDDKEYIPDPEDKKPEGYDDIPKEIPDPDATKPEDWNDEEDGEWTAPTIANPEYKGPWKPKKIKNPNYKGKWKAPMIDNPDFKDDPELYVFPNLKYLGIELWQVKSGTLFDNILISDDPEYAKKLAEETWAKHKDAEKEAFDEAEKKKEEEEKEKESDDEEDTDEKEEKSDDEDADELDDEHKEADKKEHELDSEHKEEDKKEHDEL

SEQ ID NO: 168 - DNA, 1425 bp, Populus trichocarpa
ttaacgctagcatggatctcgggccccaaataatgattttattttgactgatagtgacctgttcgttgcaacaaattgatgagcactgcttttttataatgccaactttgtaaaaaaagcaggcttaaacaatgggaaaccctaaaactctctctctctctctgattctcttttctctcttcgcgatcacatctgctaaagtcttcttcgaagaacgcttcgaagatggatgggagaatagatgggttgtatctgattggaagaaagatgagaacaccgccggggtctggaaccatacttctggaaaatggaacggagacgctaatgacaaaggtatccaaacaagtgaagactacaggttctatgctatttcagctgagttccctgaattaagcaacaaggatcagacacttgttttccaattctccgtcaagcatgagcaaaagcttgattgtggtggtggctacctgaagttgctcagtggtgaagttgaccagaagaaatttggtggtgataccccgtacagtatcatgtttggaccagatatctgtggacacagcaccaagaaagttcatgccattcttaactacaatgaaacaaaccagttgatcaagaaggaagttccctgtgagactgaccaactctctcatgtctacacatttatcatccgtcccgatgctacatacagtatccttattgacaatgtagagaagcaaactggcagtttgtacactgactgggatcttctcccgccgaagcaaatcaaggatcctgaggccaagaaacctgaagactgggatgacaaggagtatattcctgatcctgaagacaagaagccagagggttatgatgacattcccaaagaacttccagatcctgatgccaaaaagcctgaggactgggatgatgaggaagatggtgagtggactgccccaaccattcccaatcctgagtacaatggcccgtggaagccaaagaaaattaagaaccccaactaccagggcaagtggaaggcaccaaagattgacaacccagatttcaaggatgatccagaactttatgtttacccaaacttgagatatgttggcattgaattgtggcaggtgaaatctggaaccttgtttgataatgtcttggtcagtgatgaccctgagtatgcaaagcagctggctgaagaaacatggggaaagcagaaagatgctgagaaggcagcatttgaagaggcagagaagaagaaagcggatgaggaggaaaccaatgaagatgccgcaggttctgatgccgaggatgaggatgagactgatgatgtggaaggagaagattccgatgccgaaactaaagaagacaaggacggtgaggacgaagaagaagtacatgatgagctgtgatgaggaagcactcttacccagctttcttgtacaaagt

SEQ ID NO: 169 - protein, 418 aa, Populus trichocarpa
MGNPKTLSLSLILFSLFAITSAKVFFEERFEDGWENRWVVSDWKKDENTAGVWNHTSGKWNGDANDKGIQTSEDYRFYAISAEFPELSNKDQTLVFQFSVKHEQKLDCGGGYLKLLSGEVDQKKFGGDTPYSIMFGPDICGHSTKKVHAILNYNETNQLIKKEVPCETDQLSHVYTFIIRPDATYSILIDNVEKQTGSLYTDWDLLPPKQIKDPEAKKPEDWDDKEYIPDPEDKKPEGYDDIPKELPDPDAKKPEDWDDEEDGEWTAPTIPNPEYNGPWKPKKIKNPNYQGKWKAPKIDNPDFKDDPELYVYPNLRYVGIELWQVKSGTLFDNVLVSDDPEYAKQLAEETWGKQKDAEKAAFEEAEKKKADEEETNEDAAGSDAEDEDETDDVEGEDSDAETKEDKDGEDEEEVHDEL

SEQ ID NO: 170 - DNA, 1843 bp, Populus trichocarpa
ctctataaaaaccctccaaggatcactctcccagtgtaatctgctccattttcaagtaaaatggcaaaccctaaaatcatccctctgattctcttctctctcttcgcgatcgcatctgctaaagtcttcttcgaagaacgattcgaagatggatgggagaatagctgggttgtatctgattggaagaaagatgagaacactgctggggtgtggaactacacttctggaaaatggaatggagaccccaatgacaaaggtatccaaacaagtgaagactataggttctatgctatttcagctgagttccctaaattcagcaacaaggatcagacactagtcttccaattctctgtcaagcatgagcaaaagcttgactgtggtggtgggtacatgaagttgctcagtggtgaagttgaccagaagaaatttggtggtgataccccatacagtatcatgtttggaccagatatatgtggatacagcaccaagaaagtccatgccattcttaactacaatgaagcaaaccacttgatcaagaaggaagttccttgtgagactgaccagctctctcatgtctacacattgatcatccgtcctgatgctacatacagtatccttattgacaatgtggagaagcaaaccggcagtttgtactctgactgggatcttctcccaccgaagacaatcaaggatcctgaggccaagaaaccagaagattgggatgacaaggagtatattgctgatcctgaggacaagaagccagagggttatgatgacattcttaaagaacttccagatcctgaagccaaaaagcccgaggactgggatgatgaggaagatggtgagtggactgccccaaccattcctaaccctgagtacaagggcccatggaagccaaagaaaattaagaaccccaactaccagggcaaatggaaggcaccaattattgacaacccagatttcaaggatgatccagaactttatgtttaccctgacttgagatatgttggcattgagttgtggcaggtgaaatctggaaccttgtttgacaatgtcttggtctctgacgaccccgagtacgcaaagcagatggctgaagaaacatggggaaagcagaaagatgctgagaaggcagcattcgaagaggtagagaagaaaagagacgaggaggaatccaaggaagatccagctgactccgatgctgaggaggaggacgaggctggtgatgctgaaggagaggattctgatgccgagaccaaagctgacacggctgacgatgaagatgaagtacatgatgagttgtgatgaggaagctctcttgccagcaactcagtctagagataaagcttggcaccaagtgctcgtaatttttttcctcataattcgtagttgtaggagtccgttcgtttagggagggagggccaaaacgggttgagaaccgcgtggctgattgtttttaagtatccgggccttgagaaggaatgggaactgtgcttttattatcacattcataaaaatagtttgaacgttcttcaaaccccccctgctgatgttctttgcattttgttcacttgctttagttttcttaaagcctaaccaggcttggtgtgtaacaagggagttgagggagacaggcctgtatgaaaatcacatggtgggattaggccttcaatgaatgattttataggaatagctcaatggaccactggttgtgttgatgcatgctcaaatcatcagcgacgacaaacctcttgtgtttagaatactaactttagcgccatatttatcacgtcattggtatttaattaaataataaataaataaaattatcaaattcaaatct

SEQ ID NO: 171 - protein, 414 aa, Populus trichocarpa
MANPKIIPLILFSLFAIASAKVFFEERFEDGWENSWVVSDWKKDENTAGVWNYTSGKWNGDPNDKGIQTSEDYRFYAISAEFPKFSNKDQTLVFQFSVKHEQKLDCGGGYMKLLSGEVDQKKFGGDTPYSIMFGPDICGYSTKKVHAILNYNEANHLIKKEVPCETDQLSHVYTLIIRPDATYSILIDNVEKQTGSLYSDWDLLPPKTIKDPEAKKPEDWDDKEYIADPEDKKPEGYDDILKELPDPEAKKPEDWDDEEDGEWTAPTIPNPEYKGPWKPKKIKNPNYQGKWKAPIIDNPDFKDDPELYVYPDLRYVGIELWQVKSGTLFDNVLVSDDPEYAKQMAEETWGKQKDAEKAAFEEVEKKRDEEESKEDPADSDAEEEDEAGDAEGEDSDAETKADTADDEDEVHDEL

SEQ ID NO: 172 - DNA, 1529 bp, Phaseolus vulgaris
ttctttctacatccctagctctgttccgtcgatggcgatggcgatggcgtttagggtgcgaaaccctgatctccgttctctcattcttctatctctcttgaccatcgcttctgccaaggtcttcttcgaggagcgcttcgaagacggatgggaaaatcggtgggttaaatcagattggaaaaaagatgaaaacctggctgggcagtggaatcacacctctggtcaatggaatggaaacgccaacgacaaaggtattcaaaccagtgaagattacagattctacgccatttctgctgagtaccctgaattcagcaacaaggataacacgctagttttccaattttctgtcaagcatgaacagaagcttgactgtggaggtggctatatgaagttgctaagtgggagtgttgatcagaagaaatttggtggcgatactccttacagtataatgtttggaccagatatctgtggttacagtaccaagaaagtgcatgctattttgacctacaatgacacaaaccacttgatcaagaaggatgttccgtgtgagactgatcaactaactcatgtttatacatttattctccgtccagatgcaacctacaccatccttattgataatgtggagaagcaatctggtagtctctactctgattgggatcttctccctccaaagaaaatcaaggatcctgaagctaaaaagccagaagattgggatgacaaagaatatattcccgatcccgaggataagaaaccagaggggtatgacgacatccctaaagagatcccagataccgaagccaagaagcccgaagattgggatgatgaggaagatggtgagtggacacccccaaccattcccaaccctgagtacaagggcccatggaaggcaaagaaaatcaagaaccccaacttcaaaggaaagtggaaggcaccaattattgacaacccagatttcaaggacgaccccaacctctatgttttccccaacttgaagtacgtgggcattgaattgtggcaggtgaaatctggcactttgtttgacaatgtcttgattaccgatgatattgaatatgctaagcaactggccgaagaaacatggggcaagcacaaggatgctgagaagacagcatttgaagaggccgagaagaagagggaagaggaggaatcaaaggaggatccagttgactctgatgctgaggatgatgatgaggatagtgatgaagctggcaatgactccgatggtgaatcaaagacggaagctggggaagacaaggaagatggtcatgatgagctctaggcagtttgcaaaacggatgaggatttagcggaaaagtcctatcgttttcagccgtagtgttttttgttgttttttctagataagcaaactgctagtaagagctggagagcttttgtttcaatctcatttgactatttcactgattagagcagacaaaaaaaagtctcttttgtttcgattttccaattacgtttcaagtctaatagcattttctttgtaaattgtttct

SEQ ID NO: 173 - protein, 422 aa, Phaseolus vulgaris
MAMAMAFRVRNPDLRSLILLSLLTIASAKVFFEERFEDGWENRWVKSDWKKDENLAGQWNHTSGQWNGNANDKGIQTSEDYRFYAISAEYPEFSNKDNTLVFQFSVKHEQKLDCGGGYMKLLSGSVDQKKFGGDTPYSIMFGPDICGYSTKKVHAILTYNDTNHLIKKDVPCETDQLTHVYTFILRPDATYTILIDNVEKQSGSLYSDWDLLPPKKIKDPEAKKPEDWDDKEYIPDPEDKKPEGYDDIPKEIPDTEAKKPEDWDDEEDGEWTPPTIPNPEYKGPWKAKKIKNPNFKGKWKAPIIDNPDFKDDPNLYVFPNLKYVGIELWQVKSGTLFDNVLITDDIEYAKQLAEETWGKHKDAEKTAFEEAEKKREEEESKEDPVDSDAEDDDEDSDEAGNDSDGESKTEAGEDKEDGHDEL

SEQ ID NO: 174 - DNA, 1496 bp, Ricinus communis
ctagaaatggcgaaccctaaatctctctcactctttcttctctcgcttttagcgatcgcttctgcagaagtcttcttcgaggagcgtttcgaagatggatgggaaaataggtgggttaaatctgattggaagaaagatgagaatacagctggtgaatggaattatacctctggaaagtggaatggagaccctaatgacaaaggtattcaaacaagtgaagattataggttctatgctatttcagctgaattccctgaattcagtaataaagataagactctagtcttccaattttctgtcaagcatgaacagaagcttgactgtggtggtggttacatgaagttgctcagtagtagcactgaccagaagaaatttggtggtgacactccatacagtatcatgtttggacccgatatatgtggctacagcaccaaaaaagttcatgctatccttaactacaatgatacaaaccacttgatcaaaaaggaagttccatgtgaaaccgaccagttaactcatgtttacacattggtcatccgtccagatgctacttatagcattcttatcgacaatgtggagaagcaaactggtagtttgtacactgactgggatcttcttccacctaagaaaattaaggaccctgaggccaagaaaccagaagattgggatgagaaggagtatattcctgaccctgaggataagaaaccagagggttatgatgacattccaaaggagattccagatcccgatgccaagaagcctgaggattgggatgatgaggaagatggtgaatggactgccccaaccattgccaaccctgagtacaagggtccatggaaacccaagaaaattaagaaccccaactacaagggcaagtggaaagcaccaatgatcgacaacccagatttcaaggatgacccagaaatctatgtttaccccaacttgaagtatgttggtattgaattgtggcaggtgaaatctggaaccttgtttgacaatgtcttgatttgcaatgaccctgagtatgctaagcagctggctgaagagacatggggaaagaacaaagatgctgagaaggcagcatttgaagaggcagagaagaagaaagaagaggaggaatcaaaggatgatccagctgattctgatgctgacgaggacgatgatgatgctgatgacactgaaggagaagatgatggtgaaagcaaatcagatgcagcagaagacagtgctgaggacgtacatgatgaactgtagagaggaagcacttttgctgacaagcgatggagatgagcgggggcatatagtagtactcccaaaatttttctattttcttttgattcgtagctgtaggagctcttgtagggaaagaaaaatagagaaagttgcactgcagaactgcttggctgattgttttagtccccatttaaaacctgtctgagcctttagaacaaagaagatgtccttttataatcaaatttatgatttgaatgttctac

SEQ ID NO: 175 - protein, 415 aa, Ricinus communis
MANPKSLSLFLLSLLAIASAEVFFEERFEDGWENRWVKSDWKKDENTAGEWNYTSGKWNGDPNDKGIQTSEDYRFYAISAEFPEFSNKDKTLVFQFSVKHEQKLDCGGGYMKLLSSSTDQKKFGGDTPYSIMFGPDICGYSTKKVHAILNYNDTNHLIKKEVPCETDQLTHVYTLVIRPDATYSILIDNVEKQTGSLYTDWDLLPPKKIKDPEAKKPEDWDEKEYIPDPEDKKPEGYDDIPKEIPDPDAKKPEDWDDEEDGEWTAPTIANPEYKGPWKPKKIKNPNYKGKWKAPMIDNPDFKDDPEIYVYPNLKYVGIELWQVKSGTLFDNVLICNDPEYAKQLAEETWGKNKDAEKAAFEEAEKKKEEEESKDDPADSDADEDDDDADDTEGEDDGESKSDAAEDSAEDVHDEL

SEQ ID NO: 176 - DNA, 1812 bp, Sorghum bicolor
gcacgaggtacaacacgaccccgggtggccggccggggctgagatcggatcggaagcttggacaaggtttccacctggatggcgatccgcaggggcccttcgtacgccgtcgcggcactcctcgcgctcgcctctgtcgccgccgtcgccggcgaggtcttcttccaggagaagttcgaagatggctgggaaagtcggtgggtcaagtctgagtggaagaaggacgagaacatggccggtgaatggaaccacacctctgggaaatggaatggagatgccgaggacaaaggtattcagacctctgaggactacaggttctatgctatttcagctgagtaccctgagttcagcagcaaggataagaccctggtgctgcaattctctgtgaagcacgagcagaagcttgactgcggtggtggttatgtcaaattgctgggtggtgatgtagaccagaagaaatttggtggggacacaccttacagcattatgtttggaccagatatctgtgggtacagcaccaagaaggttcacactatcctgaccaaggatggcaagaaccacttgatcaagaaggatgtgccttgtgagactgatcagttgactcatgtttacactttgattatccgccctgatgcaacatacagcattctcattgataacgaagagaagcaaactggcagcatctacgagcactgggatattctgccccctaagcaaatcaaggacccagaggctaagaagcctgaggactgggatgacaaggagtacattcctgaccctgaggacaagaagcctgagggctatgatgatattcccaaggaaattcctgaccctgatgctaagaagcctgaggactgggatgatgaggaagatggtgaatggactgcccctaccattccaaacccagaatacaagggaccatggaagcaaaagaaaatcaagaacccgaactaccagggtaaatggaaggcacctatgattgacaatccagatttcaaggatgatccatacatctatgcatttgacagcctgaagtacattggcattgagctgtggcaggttaaatcaggcactttgtttgacaacttcatcatcactgatgaccctgcgttggccaagactttcgcagaggagacctggggcaagcacaaggaggcagagaaggctgctttcgatgcggctgagaaaaagaaggaagaagaggaagccgccaagggtggtgatgatgaggatgacgacctagaggatgaggaagacgatgagaaggcagacgaggacaaggctgactctgatgccgaggatagcaaggacgactctgatgatgagaagcacgacgagctctagatggtgaggatgatgatgttgtggccaccgaacttggagccgctggcctggatttatcaactctcccactatgaacttctcttttttctgtgatcatcgacaagttactgcatagagcattgctaataagccgagggatagtttgggttgctgtagcgttttttttttcccattattagaactgatagcactggacaaggaagatgtttgctcacaactgatatctcccattcttacgttaaatgtgatcctgcgaaagcataggtttcgtgacgcacgtggactgcagcgtcgttttgccgttttcgtttagagaacattcgtgcctgtttactgttctaggtatcgctagggtcttgtttcgggcaaatagctgctccgtctcgtgtctggcaaactctgctttcctatccgtttcctgccagcgccactgcttttgcctggtatgagatttgtttaaagagaatc

SEQ ID NO: 177 - protein, 421 aa, Sorghum bicolor
MAIRRGPSYAVAALLALASVAAVAGEVFFQEKFEDGWESRWVKSEWKKDENMAGEWNHTSGKWNGDAEDKGIQTSEDYRFYAISAEYPEFSSKDKTLVLQFSVKHEQKLDCGGGYVKLLGGDVDQKKFGGDTPYSIMFGPDICGYSTKKVHTILTKDGKNHLIKKDVPCETDQLTHVYTLIIRPDATYSILIDNEEKQTGSIYEHWDILPPKQIKDPEAKKPEDWDDKEYIPDPEDKKPEGYDDIPKEIPDPDAKKPEDWDDEEDGEWTAPTIPNPEYKGPWKQKKIKNPNYQGKWKAPMIDNPDFKDDPYIYAFDSLKYIGIELWQVKSGTLFDNFIITDDPALAKTFAEETWGKHKEAEKAAFDAAEKKKEEEEAAKGGDDEDDDLEDEEDDEKADEDKADSDAEDSKDDSDDEKHDEL

SEQ ID NO: 178 - DNA, 1709 bp, Sorghum bicolor
tactggatccccactaccaggaggggtttccggggcaggagaagaatcagcggaaggttctagcaggttccactcgaagtggtgggcgttccctctcgccgtccacggtgatggcgatcctcgagaggtcgtcgtcccccgccgcggcctccgtcgccgtcgcggccctgatcgcgctcgcgtccgtcgccggcgtcgccggcgaggtcttcttccaggagaagtttgacgatggatgggaggatcgatgggtcaagtccgactggaagaaggacgacaacacggcaggcgagtggaaccacacatctggcaaatggaacggagatgccgacgacaaaggaatccagacctctgaagactacaggttctacgccatttcagcgcagtaccctgagttcagcaacaaggataagaccctggtgctgcagttctcggtgaagcatgagcagaagctcgactgtggcggtggctatttgaaattgcttgggtctgatgttgatcagaagaagtttggtggcgacaccccatacagcatcatgtttgggccggatatctgcgggtatgccaccaagaaggtccacgctatccttactaagaacggcaagaaccatttgatcaagaaggaggtgccatgcgagacagaccagctgacacatgtttacaccctgatcatccggcctgatgccacatacagcattctcattgataacgatgagaagcaatctggtagcatctatgatgattgggatattcttcctccaaagaagatcaaagaccctgaagccaagaagccagaagactgggatgataaggaatacattcctgatcctgaggacaagaagccagagggttatgatgatattcccaaggaaattcctgaccctgatgcaaagaagccagaggattgggatgatgaggaagatggtgaatggactgccccaaccattcctaacccagagtacaaaggaccatggaagcaaaagaaaatcaagaatccagactacaagggcaagtggaaggcccctttgattgacaacccagatttcaaggacgatccttacatctacgcttttgacagtttgaagcacattggcattgagctgtggcaggttaaatcaggaactttgttcgacaacattttgataactgatgaccctgagtacgccaagaagttagcagtggagacctggggcaagcagaaagatgctgagaaggctgccttcgacgaggctgagaaaaagaggcttgaggaggaatctgcaagcagtaaggacgacgatgacgacttagatgtagatgaggatgaggatgatgcggacgatgacaaggctgatcatagtgatactgatgaggccgaggacagcgaagaggctaaacatgatgagctctagagcacgccgaggtagaggaataccatctttttcttttcagtttcagtttcaatcggagctgttgatgacagagttatcatcccatcccaacagaagaaggccgcagggcgtgcgccggtctcgacatatagcgagtagttgtccatccctctgtaacactactgagggcaattttcattttcccactgtagtgtcaattccccaaatgcgggccgtagtcagacatcgtgaaaccaagttttcgtcagtgttgcgtagacatattctttggtcgttgcccaagttatattaatttgcattccatgggcggaaaaaaaa

SEQ ID NO: 179 - protein, 426 aa, Sorghum bicolor
MAILERSSSPAAASVAVAALIALASVAGVAGEVFFQEKFDDGWEDRWVKSDWKKDDNTAGEWNHTSGKWNGDADDKGIQTSEDYRFYAISAQYPEFSNKDKTLVLQFSVKHEQKLDCGGGYLKLLGSDVDQKKFGGDTPYSIMFGPDICGYATKKVHAILTKNGKNHLIKKEVPCETDQLTHVYTLIIRPDATYSILIDNDEKQSGSIYDDWDILPPKKIKDPEAKKPEDWDDKEYIPDPEDKKPEGYDDIPKEIPDPDAKKPEDWDDEEDGEWTAPTIPNPEYKGPWKQKKIKNPDYKGKWKAPLIDNPDFKDDPYIYAFDSLKHIGIELWQVKSGTLFDNILITDDPEYAKKLAVETWGKQKDAEKAAFDEAEKKRLEEESASSKDDDDDLDVDEDEDDADDDKADHSDTDEAEDSEEAKHDEL

SEQ ID NO: 180 - DNA, 1570 bp, Solanum habrochaites
cacgttcacacaatagtggccatggctactcgacgaatgaaacgccctagctctctccatctcgttgctgtgttctcactactagtagtcgccgccgccgccgaggttttcttccaggaaagcttcaatgatggctgggaaagcaggtgggtaaaatctgaatggaagaaagatgaaaacatggctggagagtggaatcacacctctgggaaatggaatggtgatgccaatgacaaaggtattcagaccagtgaagactacaggttttacgccatttcggctgagttccctgaatttagtaacaagggaaagaacttagtgttccagttctctgttaagcatgagcagaagcttgactgtggtggtgggtacatgaagttgcttagtggagacgttgaccaaaagaaattcggtggtgacactccctacagtatcatgtttggaccagacatctgtggctacagtaccaagaaagttcatgctattctcacttataacgagacaaatcatttgatcaagaaggaagtcccatgtgagactgatcagctgacccatgtctacactttcatcctccgtcctgatgccacatacagtattctcattgacaatgtggagaaacagtctggtagcttgtactctgattgggacattctcccaccaaagaagatcaaggatccaagtgccaagaaacctgaagattgggatgacaaggaattcattgatgatcccgaggacaagaagccagagggctatgatgacattccagaggagataactgatcctgaagccaagaagccagaggactgggatgatgaagaagatggtgaatggacagccccaaccatccccaatccagagtacaagggcccatggaaggcaaagaaaatcaagaaccccaactacaagggaaagtggaaggctcctatgattgacaacccagacttcaaggatgacccagatctatatgttttcccaaaattgaagtatgttggagttgagctgtggcaagtgaaatctggaactttgtttgataatgttgtgatatgcgatgatccagagtttgccaagtcaattgcagaggaaacatggggaaagcagaaagatgctgaaaaggctgcttttgaggaagcagaaaagaagagagaggaggaggaatcaaagaatgctccagctgaatctgatgccgatgaagatgacgaggctgatgaggctgattcagatgatgctgatgacaagtctgactccaaggatgaggacacacatgatgaactgtaagagccaagcattttgattcaactgacaaagaagcttacttggcagtttccggaagatttcgtcctccctccccctttttttttccttattagtgaattagccccttcccaattttagtgaaaagacggagattgagggtgcatgaggtcttatatggctgattgctttgatgtcattgggactcggccgttagaaatacatgtttggttttgagtagaattttaatttaaatggtgttgaaattacactagttaatttctcctaaaggttctatttaaattgctcctttcttgtc

SEQ ID NO: 181 - protein, 417 aa, Solanum habrochaites
MATRRMKRPSSLHLVAVFSLLVVAAAAEVFFQESFNDGWESRWVKSEWKKDENMAGEWNHTSGKWNGDANDKGIQTSEDYRFYAISAEFPEFSNKGKNLVFQFSVKHEQKLDCGGGYMKLLSGDVDQKKFGGDTPYSIMFGPDICGYSTKKVHAILTYNETNHLIKKEVPCETDQLTHVYTFILRPDATYSILIDNVEKQSGSLYSDWDILPPKKIKDPSAKKPEDWDDKEFIDDPEDKKPEGYDDIPEEITDPEAKKPEDWDDEEDGEWTAPTIPNPEYKGPWKAKKIKNPNYKGKWKAPMIDNPDFKDDPDLYVFPKLKYVGVELWQVKSGTLFDNVVICDDPEFAKSIAEETWGKQKDAEKAAFEEAEKKREEEESKNAPAESDADEDDEADEADSDDADDKSDSKDEDTHDEL

SEQ ID NO: 182 - DNA, 1601 bp, Solanum tuberosum
cagagatctcacagtcagtattttccatctcacacaatagtggccatggctactcgacgaatgaaaagccctagctctctccatctcgttgctgtgttctctctactcgtagtcgccgccgccgccgaagttttcttcgaggaaagcttcaatgatggctgggagagcaggtgggtaaaatctgaatggaagaaagatgaaaacatggctggagagtggaatcacacctctgggaagtggaatggagacgccaacgacaaaggtattcagaccagtgaagacttcaggttctacgccatttcggctgagttccctgaatttagtaacaagggaaagaacttagtgttccagttctctgttaagcatgagcagaagcttgactgtggtggtgggtacatgaagttgcttagtggagacgttgaccaaaagaaattcggtggtgacactccctacagtatcatgtttggaccagacatctgtggctacagtaccaagaaagtccatgctattctcactcataacgagacaaaccacttgatcaagaaggaagtcccatgtgagactgatcagctgacccatgtctacactttcatcctccgccctgatgccacatacagtattctcattgacaatgtggagaaacagtctggtagcttgtactctgactgggacattctcccaccaaagaagatcaaggatccaagtgccaagaaacctgaagattgggatgacaaggaattcattgatgatcctgaggataagaagccagagggctatgatgacattccagaggagataactgatcccgaagccaagaagccagaggactgggatgatgaagaagatggtgaatggacagccccaaccatccccaatccggagtacaagggcccatggaaggcaaagaaaatcaagaaccccaactacaaggggaagtggaaggctcctatgattgacaacccagacttcaaggatgacccagatctatatgttttcccaaaattgaagtatgtcggagttgagctgtggcaagtgaaatctggaaccttgtttgacaatgttgtgatatgcgatgatccagagtatgccaagtccattgcagaggaaacatggggaaagcaaaaggatgctgaaaaagctgcttttgaggaagcagaaaagaagagagaggaggaggaatcaaagaatgctccagctgaatctgatgccgaggaagatgacgaggctgatgaggctgattcagatgatgctgatgacaagtctgactccaaggatgaggacacacatgatgaactgtaagggccaagcattttgattcaactgacaaagaagctacttggcagttcccggaagatttcctcctccctcccccctttctttttttttttccttagtgaattttagccccttcccaattttagtgaaaagacggagattgagggtgcatgaggtcttatatggctgattgctttgatgtcattgggactcggccaataggaatacatgtttggttttgactagaattttaaactaaatggtgttgaaattacactagttaatttctacctaattttctatttaaatggctccttgtctcgatt

SEQ ID NO: 183 - protein, 417 aa, Solanum tuberosum
MATRRMKSPSSLHLVAVFSLLVVAAAAEVFFEESFNDGWESRWVKSEWKKDENMAGEWNHTSGKWNGDANDKGIQTSEDFRFYAISAEFPEFSNKGKNLVFQFSVKHEQKLDCGGGYMKLLSGDVDQKKFGGDTPYSIMFGPDICGYSTKKVHAILTHNETNHLIKKEVPCETDQLTHVYTFILRPDATYSILIDNVEKQSGSLYSDWDILPPKKIKDPSAKKPEDWDDKEFIDDPEDKKPEGYDDIPEEITDPEAKKPEDWDDEEDGEWTAPTIPNPEYKGPWKAKKIKNPNYKGKWKAPMIDNPDFKDDPDLYVFPKLKYVGVELWQVKSGTLFDNVVICDDPEYAKSIAEETWGKQKDAEKAAFEEAEKKREEEESKNAPAESDAEEDDEADEADSDDADDKSDSKDEDTHDEL

SEQ ID NO: 184 - DNA, 1638 bp, Triticum aestivum
tgcgacccacgcgtgccgcgactggagcacgaggacactgacatggactgaaggcagtagaaaaatgggttccgatcggatcggggtaaaggcttccacgagctctcgtctcgactgccgccgcccgcccgagatggcgatccgccgtgggtcctcctgcgccgtcctcgccctgctcgcgctcgcctccgtcgccgccgtcagcgccgacgtcttcttccaggagaagttcgaagatggttgggaaagccggtgggtcaagtctgagtggaagaaggatgagaacatggctggtgaatggaaccacacatctggaaaatggcacggagatgccgaggacaaaggtatccaaacctcagaggactacaggttctacgccatctcggcggagtaccctgagttcagcaacaaggacaagacactcgtgctgcagttcacggtgaagcatgagcagaagcttgactgcggtggtggttacgtcaagttgcttggaggtgatgttgaccagaagaaattcggtggtgacacaccctacagcattatgtttggaccagatatctgtgggtacagcaccaagaaggttcacactatccttaccaaggatggcaagaaccatttgatcaagaaggacgtgccttgcgagactgatcagctgtcgcatgtgtacactttgatcatccgccctgatgccacatacagcattctcattgacaacgaagagaagcaaactggaagcatctacgagcactgggatattcttcctcccaaggaaatcaaggacccagaagctaagaagccagaggactgggatgacaaggagtacattcccgatcctgaggacgtcaagccagagggctacgatgacattcccaaggaagtcaccgatcctgatgctaagaagcctgaggattgggatgatgaggaagatggtgaatggactgccccaaccatccccaacccagagtacaagggcccatggaagcaaaagaaaatcaagaaccctaactaccagggcaaatggaaggcacctatgattgccaacccagacttcaaggatgatccttacatctatgctttcgacagcctgaagtacatcggaattgagctgtggcaggttaagtcaggaactttgtttgacaacattctcatcactgacgatgctgctttggccaagacatttgctgaagagacctgggccaagcataaggaggctgagaaggctgcttttgacgcggctgaaaagaagaaggaagaggaggatgcttccaaggctggtgaggacgatgatgacttggatgatgaggatgccgatgatgaggacaaggatgacaaggctgggtctgatgtcgagtctgatgacgagaagcacgatgagctctagatggatggtgaggatgagaggaggccgcctgccttcgcgccggtgccatgatttattagttgtctctcattatgatgttcccctttttgtgatcagaaacttgacaagttactgtgtgtagaagaacaacatcaccgtggggtctttgtagcgcttttgtagtccaatttttaccggaagggaactttatagtcgttaaacgagcaaaaaataaaaaatcttgcactagtctctcttacctcggccgcgaccacgct

SEQ ID NO: 185 - protein, 438 aa, Triticum aestivum
MGSDRIGVKASTSSRLDCRRPPEMAIRRGSSCAVLALLALASVAAVSADVFFQEKFEDGWESRWVKSEWKKDENMAGEWNHTSGKWHGDAEDKGIQTSEDYRFYAISAEYPEFSNKDKTLVLQFTVKHEQKLDCGGGYVKLLGGDVDQKKFGGDTPYSIMFGPDICGYSTKKVHTILTKDGKNHLIKKDVPCETDQLSHVYTLIIRPDATYSILIDNEEKQTGSIYEHWDILPPKEIKDPEAKKPEDWDDKEYIPDPEDVKPEGYDDIPKEVTDPDAKKPEDWDDEEDGEWTAPTIPNPEYKGPWKQKKIKNPNYQGKWKAPMIANPDFKDDPYIYAFDSLKYIGIELWQVKSGTLFDNILITDDAALAKTFAEETWAKHKEAEKAAFDAAEKKKEEEDASKAGEDDDDLDDEDADDEDKDDKAGSDVESDDEKHDEL

SEQ ID NO: 186 - DNA, 1752 bp, Triticum aestivum
ccacgcgtccggtaatggtaatcgtgaaattggtgtggttgtgtttttgctcttatctatggttgacactcaacatctgacagttactgacaccaacattggagagtcgactgacaaccatagataagagcaaaaatactgaagacagcatagattttagcatacagtgcgattagctttgtaatggtaatcgtgaaatcagggggtttttggttgccagggttcggagttcggtacacagatcggaagggtctagaagcttctggtggtgacgatggcggtcctcgcgaggtcggccgccgccgtggctgcgctcgcgctcgcgctgctcgtgtcggccgtcgccggcgaggtcttcttccaggagaagttcgacgatggatgggaggatcggtgggtcaagtcggagtggaagaaggaggacaacacggccggcgagtggaaccacacctccggcaaatggaacggagacgctgacgacaaaggcatccagacgtcggaggactacaggttctacgccatctcggcgcagtacccggagttgaggaacaaggacaagaccctggtgctgcagttctccgtcaagcacgagcaggacctcgactgcggcggcggctacatcaagctcctccccgccgacgtcgaccagaagaagttcggcggtgagaccccatacagcatcatgttcgggccggacatctgcgggtacgccaccaagaaggtgcacgcgatcctcaccaagaacggcaagaaccatctgatcaagaaggaggtgccctgcgagacggaccaactcacgcacgtctacaccttgatcctccggcccgacgccacgtacagcatcctcatcgacaacgtcgagaagcagtccggcagcgtctacgatgactgggacatccttcctgccaagaagaagagggatcctaatgccaagaagccagaggactgggaggacgaggagttccttcctgaccccgaggacaagaagccagaggggtatgatgacattcccaaggaaatcactgaacctgatgcaacgaagcctgaggactgggatgatgaggaagatggtgaatggacagctccaaccatcccaaacccggagtacaagggaccatggatccaaaagaaaatcaagaaccctaatttcaagggaaaatggaaggcacctttgatcgacaacccagagtacaaggacgatccttacatctacgcttttgacagcctgaagcacattggcattgagctgtggcaggttaaatcaggaactctgttcgacaacatcctgatcactgatgaccctgagtacgccaagaagttcgcggaggagacctggggcaagcacaaggatgctgagaaggccgcctttgatgaggccgagaagaagaggcttgaggaggaatccgcaaacactaagaccgaagacaatgacgatgcagctgatcaggaggatgagggcaaagctgccggcgccagcgatgaggagaacaaggatgcctccggcgatgaggaaattagcaaggatgcttcttcttcttccgacaagaaggacgagctttagagtgtggcaggcaggctctgtatctaaactttttcctcttgaggcagtagagcttcccatccagcaattagaagaacattttctctgaaagatgacagaagaagtaatgcaatctcggctcttgtaatttgttatgtgttttttgtcggacataggaaatatagcgtagtcatgaatctatctcggtgcct

SEQ ID NO: 187 - protein, 428 aa, Triticum aestivum
MAVLARSAAAVAALALALLVSAVAGEVFFQEKFDDGWEDRWVKSEWKKEDNTAGEWNHTSGKWNGDADDKGIQTSEDYRFYAISAQYPELRNKDKTLVLQFSVKHEQDLDCGGGYIKLLPADVDQKKFGGETPYSIMFGPDICGYATKKVHAILTKNGKNHLIKKEVPCETDQLTHVYTLILRPDATYSILIDNVEKQSGSVYDDWDILPAKKKRDPNAKKPEDWEDEEFLPDPEDKKPEGYDDIPKEITEPDATKPEDWDDEEDGEWTAPTIPNPEYKGPWIQKKIKNPNFKGKWKAPLIDNPEYKDDPYIYAFDSLKHIGIELWQVKSGTLFDNILITDDPEYAKKFAEETWGKHKDAEKAAFDEAEKKRLEEESANTKTEDNDDAADQEDEGKAAGASDEENKDASGDEEISKDASSSSDKKDEL

SEQ ID NO: 188 - DNA, 1660 bp, Vitis vinifera
  misc_feature (1630)..(1630): n is a, c, g, or t
ttctctctcttccctccccttctctctctagccatggcgattcggggaagaaaccctaaccctatctttctctctctagctctcttctctctcctctccatcgcttctgcgaaagtcttctttgaggagcgattccatgatggatgggagaataagtgggttaaatccgaatggaagaaagatgagaacatggctggggaatggaactacacctctggtaaatggcatggagacccgaatgataaaggtatccaaacaagtgaggactacagattctatgctatatcagctgagtaccctgaattcagcaacaaagataagacattagttttccaatttactgttaaacatgaacagaagcttgactgtggtggtggatacatgaagttgctcagtggtgaggttgatcaaaagaaatttggtggtgataccccatacagcatcatgtttggacctgatatctgtggctataccaccaaaaaggtccatgctattcttacacgagatggaaaaaatcacttaattaagaaggatgttccttgtgagactgaccagctatcccatgtttacactttcatcctcaagccagatgctacctacagcatcctaattgacaatgttgagaaacagactggtagtctgtactctgattgggatattctccctccaaagaagatcaaggatcctgaggccaagaaacctgaagattgggatgagaaggagtacattcctgatcctgaagatgagaagccagagggatatgatgacatcccgaaggagataccagatcctgatgcaaagaagcctgaagattgggatgatgaggaagatggtgaatggacagctccaaccattgccaaccccgagtacaagggaccatggaagccaaagaaaattaagaatcccaactacaagggaaaatggaaggcaccaatgattgacaacccagagttcaaagatgacccagagatctatgttttccccgatttgaagtatgtgggcattgaactctggcaggtgaaatcagggaccttgttcgacaatgtcttgatttgtgatgatccggagtatgcaaagcaattggtagaagaaacatgggccaagtacaaggatgctgagaaggcagcatttgatgaggcagagaagaagagggaagaggaggaatcaaaggaggacccagttgactctgatgtcgaggatgaagatgatgctgatgctgatgctgctgaggcagaagactctgattctgaagccaaattagaatcagaaacaagcaaggaagctgacagtgatgatgaagaagacaagcatgatgagctgtagggtgagccgactacaatatcatgctgacaaattggtcttgaagataaagcttgagctcaaagaatttttctttgttttttacgtttttattttaattttagttggtagggggagaaaacagttgagggctggatgcagttagactgcttggctgattgccttaagaacacattggttgtcttgagttattaggtgggggactaaaaggaaaaccatttatgcagtgtaatggtgcttccaatgacgtgaaatttttccttagaaatgctttgttttctccttatatttttatgcttggaattacacnccctttttctttaggtgtgtaatccttatt

SEQ ID NO: 189 - protein, 429 aa, Vitis vinifera
MAIRGRNPNPIFLSLALFSLLSIASAKVFFEERFHDGWENKWVKSEWKKDENMAGEWNYTSGKWHGDPNDKGIQTSEDYRFYAISAEYPEFSNKDKTLVFQFTVKHEQKLDCGGGYMKLLSGEVDQKKFGGDTPYSIMFGPDICGYTTKKVHAILTRDGKNHLIKKDVPCETDQLSHVYTFILKPDATYSILIDNVEKQTGSLYSDWDILPPKKIKDPEAKKPEDWDEKEYIPDPEDEKPEGYDDIPKEIPDPDAKKPEDWDDEEDGEWTAPTIANPEYKGPWKPKKIKNPNYKGKWKAPMIDNPEFKDDPEIYVFPDLKYVGIELWQVKSGTLFDNVLICDDPEYAKQLVEETWAKYKDAEKAAFDEAEKKREEEESKEDPVDSDVEDEDDADADAAEAEDSDSEAKLESETSKEADSDDEEDKHDEL

SEQ ID NO: 190 - DNA, 1508 bp, Welwitschia mirabilis
gaaatggccgcaggaagatcgcttagttgcgcgacgatcttgttgctctttgcttcaatcgcatcggcgaaggttttctttgaggagcgcttcgaagatggctgggagaagagatgggtacattctgactggaaaaaagatgaaaaaatggctggagagtgggtccacacatctggaaagtggaatggagatcctaataacaaaggcatccaaacccaaacagattacagattttttgccatctcagctgaatttcccgagtttagcaacaaagataagacccttgttcttcagttctcagtcaaacatgagcaaaagcttgactgtggaggtggatatgtaaagctcattagtggcgaaatggatcagaagaactttagtggagaaacaccctacagcataatgtttggacctgatatctgtggttatgccactaaaaaggttcatgcaattctgacatataaagggaaaaaccatctcatcaagaaggaagtaccatgtgaaacagatcagctcacacacgtttatacattcattctccgcccagatgctacttatagtattcttattgacaatgctgagaaacaatctggtagcctttacaaagattgggacttgttaccaccaaagcagataaaggatcctgaggccaaaaaacctgatgactgggatgataaggaattcattccggatcctgaagacaagaaacctgagggatatgatgacatccctaaagaaatacctgatcctgatgctacaaagccagaggattgggatgatgaagaggatggggaatggactgccccaactattccaaacccagaatacaaggggccatggaaaccaaagaaaataaaaaatcctaactacaagggcaagtggaaggctccaatgattgataaccctgactttaaggatgacccgaatctctatgtttttcccaatcttagatatatcggaattgaactttggcaggttaagtctggaacattgtttgacaatattttaatttgtgatgatcctgcatatgctaagcaactagcagaagaaacatggggtaaacataaagatgctgaaaaggaagcattcgaggcagaagagaaaaagagagaggaggaggagaaatctgatgacgatgatgcagaggggtctgactcagaagaagatgatgagattgaagaagaggaagagaaagaagagaaggacgaacatgatgagctatagaaggaactccagtaactgttgtttcttatttctattggactgtttgtgtagtccttaaaaaaaaaaaaagaaaaaggaaaagactggcagagcataaatgtgtttgaactaacaattagcgggtcccaaatttcttgacatttttggttacagataaaatgtaactgagttttctctatgattaagtttaatcttgaaaaaactggtagtttctctattttaaagtgttgaagccttaatgatacccaatgtcttcttttttatttaataatgttgaagtatgc

SEQ ID NO: 191 - protein, 406 aa, Welwitschia mirabilis
MAAGRSLSCATILLLFASIASAKVFFEERFEDGWEKRWVHSDWKKDEKMAGEWVHTSGKWNGDPNNKGIQTQTDYRFFAISAEFPEFSNKDKTLVLQFSVKHEQKLDCGGGYVKLISGEMDQKNFSGETPYSIMFGPDICGYATKKVHAILTYKGKNHLIKKEVPCETDQLTHVYTFILRPDATYSILIDNAEKQSGSLYKDWDLLPPKQIKDPEAKKPDDWDDKEFIPDPEDKKPEGYDDIPKEIPDPDATKPEDWDDEEDGEWTAPTIPNPEYKGPWKPKKIKNPNYKGKWKAPMIDNPDFKDDPNLYVFPNLRYIGIELWQVKSGTLFDNILICDDPAYAKQLAEETWGKHKDAEKEAFEAEEKKREEEEKSDDDDAEGSDSEEDDEIEEEEEKEEKDEHDEL

SEQ ID NO: 192 - DNA, 1728 bp, Zea mays
tatttttttgcctgaaacgagaccatatcgatagctagaacagtgatcaggcacgaatatttgtttcccttcgcggaaacggcacaacgatcctgaacctaaacacgctgcacatgcaagtccgcatgcgtgacggaaccagtgctttcgcaaaggctcacatttaacatcagaaagggagataacaatcgtgggcaaaagatccttcctccttgttcagtgttatcggctttaatgggaaaaatgactacaaagcgctacggcgacccaaactgtccatctgcttattagcagtgttctacattcttggtggtcacgggaaaaaaaaagaacttcatagtggcagagctgataaatctaggccagcggccgcaacatcatcctcgccatctagagctcgtcgtgcttctcatcatcagaatccttgctatcctcggcatcagagtcggccttgtcctcgtctgccttctcatcgtcttcctcatcctctaggtcatcatcctcatcatccccacccttggcggcatcctcttcttccttctttttctcggcctcatcaaaagcagccttttctgcctccttgtgcttgccccaggtctcctctgcaaaagtcttggccaaggcagggtcatcagtgatgatgatgttgtcaaacagagtgcccgatttaacctgccacagctcaatgccaatgtacttcaagctgtcgaaggcgtaaatgtatggatcatccttaaaatctgggttgtcaatcataggtgccttccatttaccctggtagttcgggttcttgattttcttttgtttccatggtcccttgtattctgggttgggaatggtaggggcagtccattcaccatcttcctcatcgtcccagtcctcaggcttcttagcatcagggtcaggaatttccttgggaatatcatcatagccctctggcttcttgtcctcagggtcaggaatgtactccttgtcatcccagtcctcaggcttcttagcctctgggtccttgattttcttagggggaagaatatcccagtgctcgtagatgctgccagtttgcttctcttcattatcaatgagaatgctgtatgttgcatcaggacggatgatcaaagtgtaaacatgagtcaactgatcagtctcacaaggcacatccttcttgatcaagtggttcttgccatccttggtcaggatagtgtgaaccttcttggtgctgtacccacagatatctggtccaaacataatgctgtaagatgtgtctccaccaaatttcttctggtctacatcaccacccagcaacttgacgtagccaccaccgcagtcaagcttctgctcgtgcttcacagagaactgcagcaccagggtcttatccttgttgctgaactcagggtattcggctgaaatggcatagaacctgtaatcctcggaggtttgaatacctttgtcctcggcatctccattccattttcccgaggtgtggttccattcaccagccatgttctcatccttcttccactcggacttgacccaccgactttcccagccatcttcgaacttctcctggaagaagacctcccctgcgacggcggcgacagaggcgagcgcgagaagtgccgcgacggcgtacgaagaccccttgcggatcgccataccggcgaagcccgatggaaacttatggaagcttccgatccgatctgaaccccccaggtcgtgttctatcggtcc

SEQ ID NO: 193 - protein, 420 aa, Zea mays
MAIRKGSSYAVAALLALASVAAVAGEVFFQEKFEDGWESRWVKSEWKKDENMAGEWNHTSGKWNGDAEDKGIQTSEDYRFYAISAEYPEFSNKDKTLVLQFSVKHEQKLDCGGGYVKLLGGDVDQKKFGGDTSYSIMFGPDICGYSTKKVHTILTKDGKNHLIKKDVPCETDQLTHVYTLIIRPDATYSILIDNEEKQTGSIYEHWDILPPKKIKDPEAKKPEDWDDKEYIPDPEDKKPEGYDDIPKEIPDPDAKKPEDWDDEEDGEWTAPTIPNPEYKGPWKQKKIKNPNYQGKWKAPMIDNPDFKDDPYIYAFDSLKYIGIELWQVKSGTLFDNIIITDDPALAKTFAEETWGKHKEAEKAAFDEAEKKKEEEDAAKGGDDEDDDLEDEEDDEKADEDKADSDAEDSKDSDDEKHDEL

SEQ ID NO: 194 - DNA, 1584 bp, Aquilegia formosa
cggcgttttgccggaaatggcaaagcttgcttcaataaattctacttcttgtactaaatataaactgctgcttctgcaatttctacttttatcactttatttcttcaaatactcagtttcagagatcatatttgaagagcgctttgaagatggttggcagagccgatgggttaaatctgactggaaaaaaagtgagggaaaagcaggctcgtttaagcacactgcggggaagtggtcaggagatccagaggataaaggtatccaaacataccccgatgccaagcattttgccatatctgccaagatacctgagtttagcaacaaagatagaactttggtagtccaatattctataaaaatggagcaagacattgaatgtggtggtggttacattaaacttctctctggttatgttaatcagaagaaattcggtggtgacactccttacagtatgatgtttgggccagatttatgtggttcgcagacaaaaaagcttcatgccatactttcttatcaggggcagaattatcccatcaagaaggatctgcagtgtgaaacagacaaaatgacgcatttttacacatttatccttaggcctgatgcaagttatagcatttgggtagatggtcgagaaagagaatctggaagcatgtatacagactgggatattcttccacctcgaaaaattaaagctgtcaatgcgaaaaagccgcttgattgggaagacagggagtatattgatgatcctaatgatatcaaaccagagggttatgattcaattccagctgaaattcccgatccaaaagctaaagagcctgatagctgggatgaagaagaggatggtatatggagacccccaaagataccaaatccagcatataaaggaccgtggaagcgtaagagaatcaagaaccccaattataagggaaagtggaaaattccatggattgataacccagagtttgaagacgaccctgacctttatgtgctgaaaccaatcaaatatgtcggcattgaagtttggcaggtcaaggcgggttcagtttttgacaacgtattaatatgtgatgacccggggtatgcaaaacaagttatcgaagatatcttgttcaagaataaggaggctgaaaaggaggcctttgaggaagcagaaaagttgaggcgtgctcgagaagaagaggaagctcaacgtgcaagagaagaaggtgaacggagaaggaatgaaaggggtcatgatcgaggataccgagatagagagcgctataaggacaaatatagaaggcatgatcgccgccgtgattacttggacgattatcatgatgaactctaagagacttgggacagattctggcctcctcttttctgaaagaaaatgacggaactattctcactttgtttgaaattaaatctgttttcccccctggatctcactttgtttgaatctgtttttccctgttgttgtaccactgagctgtaatcttgatgaaccaaatattctatgtccaatataatgtttggtgacctccttggtagtctagtccgtgtgactctctgtcttgtaagttatcgaacaatgaggatgag

SEQ ID NO: 195 - protein, 437 aa, Aquilegia formosa
MAKLASINSTSCTKYKLLLLQFLLLSLYFFKYSVSEIIFEERFEDGWQSRWVKSDWKKSEGKAGSFKHTAGKWSGDPEDKGIQTYPDAKHFAISAKIPEFSNKDRTLVVQYSIKMEQDIECGGGYIKLLSGYVNQKKFGGDTPYSMMFGPDLCGSQTKKLHAILSYQGQNYPIKKDLQCETDKMTHFYTFILRPDASYSIWVDGRERESGSMYTDWDILPPRKIKAVNAKKPLDWEDREYIDDPNDIKPEGYDSIPAEIPDPKAKEPDSWDEEEDGIWRPPKIPNPAYKGPWKRKRIKNPNYKGKWKIPWIDNPEFEDDPDLYVLKPIKYVGIEVWQVKAGSVFDNVLICDDPGYAKQVIEDILFKNKEAEKEAFEEAEKLRRAREEEEAQRAREEGERRRNERGHDRGYRDRERYKDKYRRHDRRRDYLDDYHDEL

SEQ ID NO: 196 - DNA, 1490 bp, Arabidopsis thaliana
agtaaccatgatgaagtgagaaattctgaaaaatgggattacctcaaaataagctcagttttttctgcttcttcttcctcgtctctgtactaactcttgccccattggctttctccgagatcttcttagaggagcatttcgaaggtggatggaaaagtaggtgggtcttgtctgattggaaaagaaacgaaggcaaagctggaacctttaagcacactgccggtaaatggcccggcgatcctgacaataaaggtattcagacttataatgatgccaagcattatgcgatttctgcaaagattcctgagtttagcaacaaaaaccggactcttgttgtccagtactcagtcaagattgaacaagacattgaatgtggtggtgcttacattaagctcctgtctggctatgttaaccagaagcagtttggtggtgatactccatacagtctaatgtttggaccagatatatgcggaacacagacgaagaagcttcatgttatagtttcatatcagggacagaattatccaatcaaaaaggatttgcaatgtgaaacagacaaattaaatcatttctacacatttattctgcgtcctgacgcttcttacagcgttctggtggataataaagagagagaatttggcagtatgtacacagactgggacatccttcctccaaggaagatcaaggtcaagaatgcaaagaagccagaggactgggatgatagagagtacatcgatgaccccaacgatgtcaaacccgagggttttgattctattccacgtgaaattccagatcgtaaagctaaagagcccgaggactgggacgaggaagaaaatggtctctgggaacctccaaagatcccaaattctgcgtacaaaggtccttggaaagcaaagagaatcaagaacccgaactacaagggaaaatggaagaacccatggatagataatccagaatttgaagatgatccagatctttacgttctgaagtctatcaaatatgcaggcattgaagtatggcaggtgaaggctggctcaatctttgacaatatattgatctgcgatgacccggcatatgcaagaagcatcgtggatgactattttgcccaacacagggagtctgagaaggagttatttgcggaagcagagaaagaaagaaaagctagagaagatgaggaagctcggatagcacgggaagaaggtgaacgcaggcggaaagaaagggaccaccggtatggagacaggaggaggcgttacaaacggccgaatccacgtgattatatggatgattaccatgacgagctatgaggcgcagagtggtgggcatttggcaaagcattgggggaaattatctatattttgctttgaatgtgtgtttgtaatttcataatttgtaaccttttgtattcatattcttataatgtattttggcatgaaaacttgacttgttatttttcccttccaatacaaaaattctaaaattggcaagaa

SEQ ID NO: 197 - protein, 424 aa, Arabidopsis thaliana
MGLPQNKLSFFCFFFLVSVLTLAPLAFSEIFLEEHFEGGWKSRWVLSDWKRNEGKAGTFKHTAGKWPGDPDNKGIQTYNDAKHYAISAKIPEFSNKNRTLVVQYSVKIEQDIECGGAYIKLLSGYVNQKQFGGDTPYSLMFGPDICGTQTKKLHVIVSYQGQNYPIKKDLQCETDKLNHFYTFILRPDASYSVLVDNKEREFGSMYTDWDILPPRKIKVKNAKKPEDWDDREYIDDPNDVKPEGFDSIPREIPDRKAKEPEDWDEEENGLWEPPKIPNSAYKGPWKAKRIKNPNYKGKWKNPWIDNPEFEDDPDLYVLKSIKYAGIEVWQVKAGSIFDNILICDDPAYARSIVDDYFAQHRESEKELFAEAEKERKAREDEEARIAREEGERRRKERDHRYGDRRRRYKRPNPRDYMDDYHDEL

SEQ ID NO: 198 - DNA, 1579 bp, Brassica napus
ggatgagagatagagattctggaaagaaatgggtttaacccaaaacaagctcaagtctttccacctcttcctcttcctcttcctcttctctcttctcactctaactcccttggctttctctgagatcttctttgaagagcatttcgaaggtggatggaaaagcagatgggtcttatctgattggaagagaaacgaaggcaaagctggcacctttaagcacaccgccggcaaatggcccggcgatcccgataataaaggtatccagacgtataatgacgccaagcattatgccatttctgcaaagattcaagagttcagcaacaagaaccggactcttgttgtccagtactctgtcaaaatcgaacaggacattgaatgtggtggcgcttacatcaagctcctctctggctacgttaaccagaagcagtttggtggtgatactccttacagtctaatgtttggaccagacatatgtggaacgcagacgaagaagcttcatgtgattctatcataccagggacagaactatccgattaaaaaggatctgcagtgtgaaacagacaagctaaaccatttctacacgtttatcttgcggcctgatgcttcttacagcgttctggttgataacaaagagagggagtttggtagtatgtacactgactgggacatccttcctccaaggaagatcaaggttaaaaatgcaaagaagccagtggactgggatgacagagagtatattgatgaccctgatgatgtcaaacctgagggttatgattcgattcctcgagaaattagagatcaaaaagctgaagagcctgaggactgggacgaggaagagaatggtccctgggaagccccaaagatcccaaatccagcgtacaaaggtccttggaaagcaaagaaaatcaagaacccgaactacaagggaaaatggaagaacccatggatagataatccagagtttgaagatgatccagatctttatgttctgaagcctataaaatacataggcattgaagtatggcaggtgaaggctggttcgatatttgacaatatcttgatcactgatgaccctcaatatgcaagaaccatggtggatgactattttgaacagcacagggagtctgagaaggagttatttgcggaagctgagaaagaaagaaaagctagagaagatgaggaatcacggaaggcaagagaagaaggggaacgtagaaggaaggagagggaccaccggtatggagacaggaggaggcgttacaaaaggcctaatccacgtgattacatggatgattaccatgacgagctgtaactgtcacagtggtggccgtttctggcagtgacaaaccaatggaaacaagtgttgatggaaataagagatatgtagagaagaacatttggaaactgttgtgtgattgtaatttgtaacctttcttgggggttaaaatgtaacccttagtattcatattcatgttaaatgtattttggcatgaaaactgttacccgtttttttggatactcacaaacctaagtgtacgtgtcgcctctaagcttgaaccttctttcaaatcacaccttt

SEQ ID NO: 199 - protein, 427 aa, Brassica napus
MGLTQNKLKSFHLFLFLFLFSLLTLTPLAFSEIFFEEHFEGGWKSRWVLSDWKRNEGKAGTFKHTAGKWPGDPDNKGIQTYNDAKHYAISAKIQEFSNKNRTLVVQYSVKIEQDIECGGAYIKLLSGYVNQKQFGGDTPYSLMFGPDICGTQTKKLHVILSYQGQNYPIKKDLQCETDKLNHFYTFILRPDASYSVLVDNKEREFGSMYTDWDILPPRKIKVKNAKKPVDWDDREYIDDPDDVKPEGYDSIPREIRDQKAEEPEDWDEEENGPWEAPKIPNPAYKGPWKAKKIKNPNYKGKWKNPWIDNPEFEDDPDLYVLKPIKYIGIEVWQVKAGSIFDNILITDDPQYARTMVDDYFEQHRESEKELFAEAEKERKAREDEESRKAREEGERRRKERDHRYGDRRRRYKRPNPRDYMDDYHDEL

SEQ ID NO: 200 - DNA, 1588 bp, Centaurea maculosa
cgcggggaccccaaattatgccttgtgccatttttacactttgctgctagaaagatgagcaaccatggagttggaaggtcttcatctctatctctcatctttggagcacttctatttgttctactctccatctgtgatttctcctactcagagatcatcttcgaggagcgatttgaagatgggtggcagagccggtgggtgaagtctgattggaaaagaagtgaagggaaggcgggtaattttaagcacacagccgggtcatggtctggtgatccagatgataaaggtattcagacaacgactgatgccagacattttgccatatctgcaaagattccagaattcaacaacaaaaatagaacattggtgttacagtactcgatcaaaatcgaacaggatatcgaatgtggtggtggttatatcaagcttatgtctggatatgtcaaccaaaagaaatttggtggtgacactccatatagtgtgatgtttggaccagatctatgtggcacacagacaaagaagcttcatgttatcctttcgtaccaggggcaaaattatccgatcaagaaggatctacagtgtgaaacagacaagttaacccatttctacacgttcatccttcggcctgatgcaagttatagcattctaatagatggcagggaaagagattccggaagtatgtatacagactgggatatccttccaccccgtaaaatcaaagacgtgaaggccaaaaagcctgctgattgggaggaaagagaatatattgaagatccagatcaagttaagcctgagggctatgattcaatcccgagagaaattcctgacccgaaagctaaacagcctgatacctgggatgaagatgaggatgggatatggagaccaccaaagataccaaatccggcatacaaagggccatggaagccaaagaaaataaaaaatccaaactacaaggggaaatggaagatcccttggatcgataacccagaatttgaagatgatcctgatctatatgtgctcaagccaattaaatatgtgggaatagaggtttggcaggtaaaagctggatctgtatacgacaacattctcatttgtgacgatcccgagtatgcaaaagatgtgatacaagaagttttcaccaatagagagattgaaaaagaagcattagaggaagcagagaaagcaaaaaaagcaagggaggaagaggaagcacaaagggcaagagaggaaggtgaaaggaggaagagagaacggggttatgatagaaggcaccgagataaggagcgctacaaggatagatacagaaagtacaatcgccgtgattaccttgacgattatcatgatgagctttgagatttgtcgatccatgccttaccgtgcagtgtgcagttaccacagccgatttatttcctttttcataattaaattgtagcattacttacggttgttgtaccaccgaactattgtcgggtaaaaatcccatgatgtgacctcttagggtgcagctaagttgcatttttgtggtgaacacttgcggatgcaaatttatcgtcaactttaagatcaatttgaaatttctggttgccac

SEQ ID NO: 201 - protein, 432 aa, Centaurea maculosa
MSNHGVGRSSSLSLIFGALLFVLLSICDFSYSEIIFEERFEDGWQSRWVKSDWKRSEGKAGNFKHTAGSWSGDPDDKGIQTTTDARHFAISAKIPEFNNKNRTLVLQYSIKIEQDIECGGGYIKLMSGYVNQKKFGGDTPYSVMFGPDLCGTQTKKLHVILSYQGQNYPIKKDLQCETDKLTHFYTFILRPDASYSILIDGRERDSGSMYTDWDILPPRKIKDVKAKKPADWEEREYIEDPDQVKPEGYDSIPREIPDPKAKQPDTWDEDEDGIWRPPKIPNPAYKGPWKPKKIKNPNYKGKWKIPWIDNPEFEDDPDLYVLKPIKYVGIEVWQVKAGSVYDNILICDDPEYAKDVIQEVFTNREIEKEALEEAEKAKKAREEEEAQRAREEGERRKRERGYDRRHRDKERYKDRYRKYNRRDYLDDYHDEL

SEQ ID NO: 202 - DNA, 1425 bp, Euphorbia esula
ggcacgaggctcaaatggggaagctttgtttacttaagcttgagcttttgccattcttgattctaattcttgctcaactctctctagctgagatcatttttgaagagagatttgatgatgggtggcatagcaggtgggttaaatcagattggaagaaaagcgagggaaaggctggaactttcaaacacacagctgggaagtggaatggagatccagatgataaaggcattcaaacagcaggcgatgccaaacattttgcagtatcagctaagataccggagtttacaaacaagaatagaaccctggtccttcagtattctataagatttgagcaggatatcgaatgtggtggtggctatattaagcttctctccggatttgtaaatcaaaagaaatttggtggagacactccttacagtttaatgtttggaccggatatttgtgggacacaaacaaagaagttacatgtcatactttcataccaaggccaaaattatccaatcaagaaggagttggaatgtgaaactgacaagttgactcatttctatacattcattctgaggcctgatgcaagttatagcattctgatcgatggccgggaaagggattccggtagcatgtacacagattgggatattcttccacctagaaaacttagagataccaaggccaaaaagcctaaagactgggatgatagggagtacattgatgatcctaacgcagtcaaacctcagggatatgataagattccaaaggaaattcctgatcatagtgctaaagagcctattgattgggatgatgaagtgaatggcatatggagaccaccaatggtaccaaatccagcttataaaggaccatggaagcccaagagaatcaagaatcctaattacaagggaaaatggaagattccttatattgataatccagagtttgaagatgatcctgatctttatgtgcttaagcccataaaatacgttggaattgaagtctggcaggtaaaatccgggactatctttgacaatgttttgatatgtgatgaaccagagtacgcaaaagaagtagttcaagaagtattagccaatagagagattgaaaaagaagcatttgaggaagccgagaagatcagaagagcccgggaggaagaggaagctcaaagagcaagagaggaaggtgaaagaaggagacgagaaagaggacatgatcgacgccgtgacagatatagagatagatacagaaagcataatccccgcgatgacttcgatgattatcatgatgagctatgaagggtttttgtgtgccttttttccttaattgccagaatctggagtcagccattgttaccttgagttttcctgattgttgtacaatttttccagctgcaatatttgtattagaaataaaccaaaataataaaaattttggtag

SEQ ID NO: 203 - protein, 422 aa, Euphorbia esula
MGKLCLLKLELLPFLILILAQLSLAEIIFEERFDDGWHSRWVKSDWKKSEGKAGTFKHTAGKWNGDPDDKGIQTAGDAKHFAVSAKIPEFTNKNRTLVLQYSIRFEQDIECGGGYIKLLSGFVNQKKFGGDTPYSLMFGPDICGTQTKKLHVILSYQGQNYPIKKELECETDKLTHFYTFILRPDASYSILIDGRERDSGSMYTDWDILPPRKLRDTKAKKPKDWDDREYIDDPNAVKPQGYDKIPKEIPDHSAKEPIDWDDEVNGIWRPPMVPNPAYKGPWKPKRIKNPNYKGKWKIPYIDNPEFEDDPDLYVLKPIKYVGIEVWQVKSGTIFDNVLICDEPEYAKEVVQEVLANREIEKEAFEEAEKIRRAREEEEAQRAREEGERRRRERGHDRRRDRYRDRYRKHNPRDDFDDYHDEL

SEQ ID NO: 204 - DNA, 1672 bp, Gossypium raimondii
gggatcacaccgagccagtgtccgttttacacgattccgtttatagcttagctttgcttagcttcttttagatcaaaactctcattgaaacaccatattaatgagttaaaaatctttaccggaaatgggcaaacttgttcccaatcgctcgtttttccttttatttttcctttttcttcactttctcctcttcgatttcgctctctctgagattttcttcgaagaacgcttcgaagatgggtggaagagccgatgggtgctgtcagattggaaaaggagtgagggaaaagccggcacctttaagcacaccgccggcaagtggtctggcgatcctgatgataagggtattcagacttataatgatgccaaacattatgccatctctgctaagataccagagtttagcaacaaaaacagaactctagtggtccagtattctattaaaattgaacaagacattgaatgtggtggtggttacatcaagcttctctccggttatgtaaaccaaaagaaatttggtggcgacactccttacagtttcatgttcggaccagatatttgtggcacacagaccaaaaagctccatgttatactatcctaccagggacaaaattatcctattagaaaggatctacaatgtgaaacggacaagctaactcacttttacacatttattctaaggcctgatgcctcttatagcgtcttaattgataacagagagagagaaacaggcagcatgtatactgattgggatatccttcctccacgaaaaataaaggatgttaaagccaaaaagcctgcagattgggatgatagagaatacattgaggaccctaatgatgtcaaaccggagggatatgataaaattccagctcagattccagatccaaaggcaaaagagcctgatgactgggatgatgaagaggatggtatttggaaaccacctaagatcccaaacccagcatacaaaggaccatggaagcgtaagaaaatcaagaaccccaactacaagggaaagtggaagactccatggattgataacccagagttcgaagatgatccggacctctatgtgctgagaccaataaaatatgtgggtattgaagtctggcaggtaaaggctggttcggtttttgacaacatattgatttgtgatgacccacaatatgcaagagaagttgtagaagatatatgggccaggaatagggaggccgaaaaggaagcctttgaagaagcagagaaagaacgaagagcccgggaagaggaggaagccaaaacacctagagaggaaggtgaaaagcggagaaaagagagggaccaccgacatagagacaggaggcaccgtagaaggcacgatcctcgtgattatctggacgattaccatgatgaactatgaggttgtccaccacaatttcgcgagttttaggatcccatttcgattacgaaaaagagaaaaatcgaagcaaggttccatgctgtgagagttggggttaccccgtactggttgttctcattgttgtcgttgttgttgtaacatcagtgttgtaatatgaacattgaagctgaaaactgctaacattccatgatccacctcatgtttgtatgctaattttgttgaataaaagggaactttcaattattgttgttttgcttaaaaaaattaaaaggaaaa

SEQ ID NO: 205 - protein, 423 aa, Gossypium raimondii
MGKLVPNRSFFLLFFLFLHFLLFDFALSEIFFEERFEDGWKSRWVLSDWKRSEGKAGTFKHTAGKWSGDPDDKGIQTYNDAKHYAISAKIPEFSNKNRTLVVQYSIKIEQDIECGGGYIKLLSGYVNQKKFGGDTPYSFMFGPDICGTQTKKLHVILSYQGQNYPIRKDLQCETDKLTHFYTFILRPDASYSVLIDNRERETGSMYTDWDILPPRKIKDVKAKKPADWDDREYIEDPNDVKPEGYDKIPAQIPDPKAKEPDDWDDEEDGIWKPPKIPNPAYKGPWKRKKIKNPNYKGKWKTPWIDNPEFEDDPDLYVLRPIKYVGIEVWQVKAGSVFDNILICDDPQYAREVVEDIWARNREAEKEAFEEAEKERRAREEEEAKTPREEGEKRRKERDHRHRDRRHRRRHDPRDYLDDYHDEL

SEQ ID NO: 206 - DNA, 1634 bp, Hordeum vulgare
cagccaccacctactcttcgtgtccggcgatgtgtagcagccgccggcggggcgaccgccagctccagctcctgcaccggctactcgcgctctcctggctgctcctgctggcctccggggaggtcatcttcgaggagcggttcgaagatggttgggagacacgtcgggtgaaatccgattggaaaaggagcgaagggaaagccggtacattcaagcacacggcagggaaatattctggggatcctgatgacaaaggcattcaaacaacgatagatgctaggcattttgccatctcagccaagataccggagttcagtaacaagggccgaacattggtggtccagtactccataaagtttgagcaggaaattgaatgtggcggcggctatattaagctaatgtctggttatgtcaatcagaagaaatatagtggagacactccatacagcttgatgtttgggccagatatatgcgggactcaaacaaagaagctgcatcttatactctcttaccaggggcagaactatcctatcaaaaaagatctacaatgcgaaaccgacaggctcacgcatgtttacacattcattcttaggcccgatgcatcttatagtttacttgttgataaccgtgaaagagaatctgggagcatgtacactgattgggacatcttgcctcctcgtaaaatcaaggatgttggtgccaaaaagcctaaggattgggatgacagagagtatattgaggatcccgatgcggttaaacctgagggctatgattctattccaagagagattcctgacccaaaggataagaagcccgacacgtgggacgatgatgatgatggcatatggaaacctaggaggataccgaatccagcatacaaaggacaatggaagcgcaagaaaattaagaaccctaactacaagggtaaatggaagatcccatggattgataatccagagtttgaggatgatccagatttatatgtactgaaacctctgaagtatattggaattgaagtttggcaggtaaaagccggttctgtttttgacaacatcctcatttgcgatgacccggaatatgcaaaacaggttgccgatgaaacgtggggtgcaaataaggaggctgaaaaggaggcttttgaagaagctgaaaaggagaggaaagctagagaagataaggaagctcaacaagcaagggaggaaggagagcgacggaggagagagaggggtgatcgacaccgtggcagggaccactacaaggacagatacaaaagacgcaacagggatcactgggatgactaccatgatgagctttgaggccccaaaaatcttccattattcgaaggagaagctgggatttgacatgaacattgcgttatagttgctgccaataattgaagtgttccttgtctcgtgtgagggaaactgattgaattgaccacgaagatcattcctatgtgacagcagggcagacaattccacctatcctcaaaagtcaaaaacttggccttggccctgaaatctgatgttgtgagtgtaatgtacatggtcagcgatgtgcttccttttgtaaacagctgttgctaatacaaataaagagattttcaagcataattcaaatgactattgttgctc

SEQ ID NO: 207 - protein, 428 aa, Hordeum vulgare
MCSSRRRGDRQLQLLHRLLALSWLLLLASGEVIFEERFEDGWETRRVKSDWKRSEGKAGTFKHTAGKYSGDPDDKGIQTTIDARHFAISAKIPEFSNKGRTLVVQYSIKFEQEIECGGGYIKLMSGYVNQKKYSGDTPYSLMFGPDICGTQTKKLHLILSYQGQNYPIKKDLQCETDRLTHVYTFILRPDASYSLLVDNRERESGSMYTDWDILPPRKIKDVGAKKPKDWDDREYIEDPDAVKPEGYDSIPREIPDPKDKKPDTWDDDDDGIWKPRRIPNPAYKGQWKRKKIKNPNYKGKWKIPWIDNPEFEDDPDLYVLKPLKYIGIEVWQVKAGSVFDNILICDDPEYAKQVADETWGANKEAEKEAFEEAEKERKAREDKEAQQAREEGERRRRERGDRHRGRDHYKDRYKRRNRDHWDDYHDEL

SEQ ID NO: 208 - DNA, 1705 bp, Malus domestica
atccccgaattacatgggagacttgggggcaagcttttgcatcccctgctataagtaaaccaataatacaaactctatcttccaatctgctcttggcttttggcttttgtcactgcaattcttgcacttgcgcaggcaaatatggcgaagcggcaaaagcatgatgagctgcttctgctagtattatcactctccttgctctccttttgctttcgttcttcgctttcggagatcattttcgaggagcgcttcgacgacgacggatggcgaagccgttgggtcaaatctgactggaaaagcagtgaaggtaaagcaggttcctttaaacatacagccggaaagtgggccggtgaccacgatgatagaggaattcagacatctaatgatgccaagcattttgccatatctgcaaagataccggagttcagcaacaagaacaggacgttggtcctccaatactcgatcaaatttgagcaggaaattgaatgtggcggcggttacataaagcttatgtctggatttgttaatcagaagaaattcggcggggacactccatacagtttaatgtttggccccgatatatgtggcacggacacaaagaagctccatgtcatactctcctaccaaggccagaattaccccatcaagaaggccttagagtgtgaaactgacaagttgactcatttctacacattcattcttcggcctgatgcaacttatagtgtcctaatagacaaccgagaaaaggattctggaagcatgtacacagattgggatattcttcctccaagaaagataaaagatgttactgcaaagaagccagcagactgggatcttagagaatacattgatgatcctaatcacatcaaacctgagggatatgattcaattccgagagaaattccagatccaaaagcaaaagagcccgaagactgggatgatgaagagaacggtctgtggaaagctccaaagataccaaatccagcttacaagggaccatggagacccaagaaaatcaagaaccctaattacaaagggaaatggaagattccttggattgataatccagagtttgaagatgatcctgatctctacgtgcttaagccaattaagtatgttggtatcgaagtttggcaggtaaaggctggttcagtttttgacaacgttttaatttgtgatgatccggattatgcaaaacaagtggtcgaggaagttttcgccaatagagaggtcgaaaaggatgcccttgaagaagcagaaaaaaggaggaaagcacaagaggaagaggaagctcaaagagcaagagaagagggtgaaaggaggagaagagatagggatcgaggtcaccgggacaggcatagagacagataccgaaggcaccgtcactgggatgactatgatcatgacgagctatgattggatttcctccaccccccagcttccttgcggtttcgttttgaagagattgacagtcacttttttctgccttcgtttccgagaaatgcagtcacttttccttcatgttttaaaatgtccttggccgtgtaactttatttctgaatgtattctgtataatgtatttttcgtaaagttagcttccgcatgtaattgtttattaataaaaaacaagtccacatgttataatttgagcaggacggacagtattgtgacgtgcctgtactcttttgttccttcatatggttac

SEQ ID NO: 209 - protein, 424 aa, Malus domestica
MAKRQKHDELLLLVLSLSLLSFCFRSSLSEIIFEERFDDDGWRSRWVKSDWKSSEGKAGSFKHTAGKWAGDHDDRGIQTSNDAKHFAISAKIPEFSNKNRTLVLQYSIKFEQEIECGGGYIKLMSGFVNQKKFGGDTPYSLMFGPDICGTDTKKLHVILSYQGQNYPIKKALECETDKLTHFYTFILRPDATYSVLIDNREKDSGSMYTDWDILPPRKIKDVTAKKPADWDLREYIDDPNHIKPEGYDSIPREIPDPKAKEPEDWDDEENGLWKAPKIPNPAYKGPWRPKKIKNPNYKGKWKIPWIDNPEFEDDPDLYVLKPIKYVGIEVWQVKAGSVFDNVLICDDPDYAKQVVEEVFANREVEKDALEEAEKRRKAQEEEEAQRAREEGERRRRDRDRGHRDRHRDRYRRHRHWDDYDHDEL

SEQ ID NO: 210 - DNA, 1464 bp, Medicago truncatula
cggccggggggagtgtcagaacaaaaattgcttattccgcaaatggcggaaaatgcttcaactgaactgaagatgtttgtgttattctgtttgttgctaatacaagtttcactttctgaagtcatcttcgaagagcgttttgaagatggatggcgaagtcgttgggtaagatcagactggaaaagtagcgaaggcaaagccggttcgttcaagcacacggctgggaaatgggctggagatccagatgataaaggtatccaaacatctaatgatgccaaacattttgccatctctgcaaagataccagaattcagtaacaagaacagaacactagtcttccagtattctataaaatttgaacaagagattgagtgtggtggaggttatatgaagctcctctctggatttgttaatcagaaaaaatttggtggggatacgccgtatagtgtaatgtttggaccagatttatgtggaacagacacaaagaagctccatgtcatagtctcttaccaaggtcaaaattacccggtaaagaaggacctgcagtgtgaaactgacaagttaactcatttctacacattcattctcaggccagatgctacatacagtgttctggttgataatagagagcgagattctggaagcttgtatacagattgggatattctccctcctcgtaaaatcaaagatctcaaggcaaaaaagcctgcagactgggaagacagagaatacattgaagaccctaatgctgtcaaacctgagggatatgattcaatcccagcagaaattcctgatccaaaggctaaagagcctgatagttgggatgaagacgaagatggaatatggaagcggccgaagataccgaatccagcatacaaaggaccatggaaacgaaagaaaatcaagaatcctaactacaaagggaaatggaaaactccatggatagataatccagagtttgaagatgaccctgatctttatgtgcttaagcctatcaaatatgtcggcatagaagtttggcaggttaaaggtggttcagtatttgacaacattttgatttgcgatgatcctgaatatgcaaaacaagttgttgatgaagtgtttgccaacagggagattgaaaaagaggcttttgaggaagcagagaaagtaagaaaagcccaagaagaggaggaggctcaaagagcaagagaagacggtgaaaggcggagaaaagagagaggctatgatcgacaccgtgatagacatagagacagatatagaaaggatgaactatgatggtataaagcggccttctttgttatctgttatctgattgacaagagtttatgtattagttatgaattatgttcaccttgatattgatagtatgttccatctggtgttaatttattggaaacttaataatgatatatagtttggttccaagccttgttgcaaagtatattatgtaatgtgcacgag

SEQ ID NO: 211 - protein, 411 aa, Medicago truncatula
MAENASTELKMFVLFCLLLIQVSLSEVIFEERFEDGWRSRWVRSDWKSSEGKAGSFKHTAGKWAGDPDDKGIQTSNDAKHFAISAKIPEFSNKNRTLVFQYSIKFEQEIECGGGYMKLLSGFVNQKKFGGDTPYSVMFGPDLCGTDTKKLHVIVSYQGQNYPVKKDLQCETDKLTHFYTFILRPDATYSVLVDNRERDSGSLYTDWDILPPRKIKDLKAKKPADWEDREYIEDPNAVKPEGYDSIPAEIPDPKAKEPDSWDEDEDGIWKRPKIPNPAYKGPWKRKKIKNPNYKGKWKTPWIDNPEFEDDPDLYVLKPIKYVGIEVWQVKGGSVFDNILICDDPEYAKQVVDEVFANREIEKEAFEEAEKVRKAQEEEEAQRAREDGERRRKERGYDRHRDRHRDRYRKDEL

SEQ ID NO: 212 - DNA, 1812 bp, Oryza sativa
cattgcatcggaatgcttgcagctttaccgagccaccggagtagcctcgtcttctccggcgagccaccggcgatgggaagtcgcagcggcggccgccaccgactcttcctccgattcatcgccctctggtcgctgctcctcatcgccgccggggaggtcatcttcgaggagcgcttcgaagatggttgggagtcccgctgggtgaagtctgattggaaaaggagcgaagggaaagctggaacgttcaaacacacggcaggaagatattctggagatcctgatgacaaaggtatacagacaacgttggacgccaggcattttgctatatcggccaagatccccgaattcagtaacaagggccgtacattggtactccagtattccataaagtttgagcaggatattgaatgtggtggtggatatattaaacttatgtctggttatgtcaaccagaagaaatttagtggagacactccatacagcttaatgtttgggccagatatatgcggaactcaaacgaagaagctccatcttatactttcttatcaagggcagaactaccctatcaagaaagatctgcaatgtgaaacagacaagttgacgcatgtttacacattcatactaaggcctgatgcgtcctatagcatactagttgataaccgtgaaagagaatcagggagcatgtacactgactgggacatcctccctcctcgcaagattaaggatgttcatgccaaaaagcctaaggattgggatgacagagaatatattgaggatccagatgcagttaaaccagagggctatgattctattccaaaggagattcctgatccaaaagacaaaaagcctgacacgtgggatgatgatgatgatggcatatggaagcctagaatgataccaaatccagcatacaagggaccatggaagcgcaagaaaatcaagaatcctaactacaagggtaaatggaagatcccatggattgataatccagagtttgaggatgatccagacctatatgtgctgaaacccttgaaatatattggaattgaggtttggcaggtaaaggctggttcggtttttgacaacatcctcatttgtgacgatccggaatatgcaagaaaagctgctgaggaaacatggggtgcaaacagggaggccgaaaaagaggcttttgaagaagctgagaaggagaggaaagctagagaggataaggaagctgaacgagcaagggaggaaggagagcgacggaggagagagaggggtgatcggcaccgtggcagggattacaaggacagatacaaaagacgtcatagggatcactgggatgatgactaccatgatgagctttgaaatcacggaaaaatgctttcttcctaggagaagctggaatttgcatggtcattgcttataattgttaccaataaatgatctgggaggccagaatagccgcaagtgttccttgctgcgtgtgctgaaaatttgaatatccggattggaatgaaatgaacaaaagcctgaagatcattccttttggacagcagggcatacgattctacttaccagcaacacgttgtttttagttgtgaattggtgaaatgttgacgttgtaacgttgcgacttgcgaatataatgtgcacggggtgatgttctgccactttttgaacactgaacattttactgcatatcaagctagcaactgcaagcagcttcctgccaaagagtttgtcttcactgtattcatctgtgttattctaagaataatgccacagtgcaatcaacatacacgaatgcataagtttcagggtttcagc

SEQ ID NO: 213 - protein, 445 aa, Oryza sativa
MLAALPSHRSSLVFSGEPPAMGSRSGGRHRLFLRFIALWSLLLIAAGEVIFEERFEDGWESRWVKSDWKRSEGKAGTFKHTAGRYSGDPDDKGIQTTLDARHFAISAKIPEFSNKGRTLVLQYSIKFEQDIECGGGYIKLMSGYVNQKKFSGDTPYSLMFGPDICGTQTKKLHLILSYQGQNYPIKKDLQCETDKLTHVYTFILRPDASYSILVDNRERESGSMYTDWDILPPRKIKDVHAKKPKDWDDREYIEDPDAVKPEGYDSIPKEIPDPKDKKPDTWDDDDDGIWKPRMIPNPAYKGPWKRKKIKNPNYKGKWKIPWIDNPEFEDDPDLYVLKPLKYIGIEVWQVKAGSVFDNILICDDPEYARKAAEETWGANREAEKEAFEEAEKERKAREDKEAERAREEGERRRRERGDRHRGRDYKDRYKRRHRDHWDDDYHDEL

SEQ ID NO: 214 - DNA, 1762 bp, Oryza sativa
agcagtgaagcgtacagccgagctaccaccactctccggcgccggcgagcggcggacacggcgacggcgatgggtcgcctccgccgcggcggggtcggtctcctgcgtggtgccgtggtgctcgcgtcccttctcctcgtcgtctccggcgaagtcatcttcgaggagcgattcgatgatgattggggaagcagatgggtgaaatctgactggaaaaagagcgaagggaaagccgggacattcaaacatacagcagggagctattctggagatcctgacgatagaggtatacaaacaacctcggatgctaagcattttgctatatcggccaagttcccagaattcagtaacaagaaccggacattggtggttcagtattcgataaagattgagcaggatattgaatgtggtggtgcttatatcaagcttatgtctggctatgtgaatcagaagaaatttggcggtgacactccttatagcttcatgtttgggcctgatatatgtggtgatcagacaaagaaactccatctgatactgtcttaccaagggcaaaactaccctataaagaaagatctgaaatgtgaaactgacaagttgacacatttttacacattcattcttaggccagatgcctcttatagtctacttgttgataaccgggagagagaatttggtagtatgtacactgactgggacatcctccctcctcgcaagatcaaagaatctaatgcgaagaagccaaaagattgggatgacagggaatatattgaagatcctgatgaagttaaaccagagggctatgactctattcctaaagagattcctgatccaaaggacaaaaagcctgagtcatgggatgatgatgatgatggtgtatggaagcctagaatgataccgaatccagaatacaagggacgttggaaacgcaagaaaattaagaaccctaactacaagggaaaatggaagatcccatggattgataatccagaatttgaggacgacccagacctatatgtgctgaaacctttgcagtatgtgggaattgaggtttggcaggtgaaagctggttcagtttttgacaacattttgatttgtgacgacccggagtatgcaagaagtgttgttgatgaagttagggctgcaaataaagaggctgaaaaggaggccttcgaggaggctgaaaagcggaggaaggctagagaagacgaggaggctcggcgtgcacgagaggaaggagagaaacgaagaagagacagggatcggcaccgaggcagggaccgttacagggatagatatagaggtcatcatcgtaggtatgactaccatgacgagctatgaggtctccagattatcccattctttcaaggaacttcaggaagttagtgttgcccatcgactatttcatcacccaattgatgattgtaccaataaaatagaacatgttatttcgaggacagaacaaagctttatttcaggtgtggatagcacactacaacacgaactgatgctgttcacctgaaaccaagtaacaaactgaagatgtgaaagctagaacgtacatttttgggcagtaacaatatgctagcgaagaggacgatatgtttccatcttccagtaatatttctccttattagtgccttagaacatagaaaataaatcactctaggttgtgaaatataaactgtactttcattgtacttcagttatatatatctggcagtgtgtgttactaatgttcagagagtaatgttttcctttcttc

SEQ ID NO: 215 - protein, 422 aa, Oryza sativa
MGRLRRGGVGLLRGAVVLASLLLVVSGEVIFEERFDDDWGSRWVKSDWKKSEGKAGTFKHTAGSYSGDPDDRGIQTTSDAKHFAISAKFPEFSNKNRTLVVQYSIKIEQDIECGGAYIKLMSGYVNQKKFGGDTPYSFMFGPDICGDQTKKLHLILSYQGQNYPIKKDLKCETDKLTHFYTFILRPDASYSLLVDNREREFGSMYTDWDILPPRKIKESNAKKPKDWDDREYIEDPDEVKPEGYDSIPKEIPDPKDKKPESWDDDDDGVWKPRMIPNPEYKGRWKRKKIKNPNYKGKWKIPWIDNPEFEDDPDLYVLKPLQYVGIEVWQVKAGSVFDNILICDDPEYARSVVDEVRAANKEAEKEAFEEAEKRRKAREDEEARRAREEGEKRRRDRDRHRGRDRYRDRYRGHHRRYDYHDEL

SEQ ID NO: 216 - DNA, 1448 bp, Physcomitrella patens
agtttgttatttttgtccccagccatggccgctcctccagccctctttcctgcgttgctcttggtcttgtcggtcgtttgtcttgctgcatgcgaggtcatcttccaagagcgtttcgatgacggttgggagagtcgctggattcaatcaaactggaagaaaagtcaaggccttaatggaaactttgtgcacactcctggcaagtggtatggagacgaaaatgacaaaggaattcaaacatcaactgactcgcgatattatgctatctctgcacaaattcctgagttcaacaacaagggcaagacgctagtactccaataccaagtcaaacacgaacaaaacatcgaatgtgggggtggctacgtgaagttaatgagtggtcaggtggaccaaaagacttttggtggtgacactccttacagtatcatgtttggacctgatatttgtggttctcaaaccaaaaaaatccatgccatcatcttgtacaagagtaaaaaccatcaaatgaaaaagacagtggagtgcgagactgacaagctctcccacgtgtatacatttatcatccgaccggacgctacttacagtattttggttgataacaaagagaaggaatctggtagcttgtacaaagattgggacttgttgccaccccgaaagattaaagacctcagtgctaagaagccggaagactgggatgacaacgaattcattccagaccccgaggaccataaacccgaggggtatgactcaataccaaaggaaatcccagatcttgatgctaagaagccagaagagtgggatgatgaaagtgacggagaatgggaagctccattaattccaaacccagaattcaaagggccgtggacgccaaaggaaattaagaaccctaattacaacggcaaatggaaggctccacttattagtaacccagaattcgaagaggatcctgatctgtatgttttgcctccattaaagtatttcggtatggagctatggcaggtaaaggcagggtcggtttttgacaacattctagtaacagacgatccagagtatgccaaaaagtttgctgaggagacttggggaaatatcaaggaaggtgagaaggaaatgtttgacgagctcgagaacaagaaccgcgaagaacagaagatcgacgacaatgatccgaatgaagaaaaggacgattatgacgaggatgacgatgatgatgatcatgatgaactttgaattcatagcggttcgccaaatgagtgaatatggagcagtaagctgatctatcgagaagagaatttagtacatgtgcggatacgtcccatttgtggatggtgttgcagtttttctctggctaattctccagcgatcgtttagacatgttcctcccaattcgattactttggttgtgttgtgccatgctaacctggtcgcatgctatgggcggtttgtttggc

SEQ ID NO: 217 - protein, 400 aa, Physcomitrella patens
MAAPPALFPALLLVLSVVCLAACEVIFQERFDDGWESRWIQSNWKKSQGLNGNFVHTPGKWYGDENDKGIQTSTDSRYYAISAQIPEFNNKGKTLVLQYQVKHEQNIECGGGYVKLMSGQVDQKTFGGDTPYSIMFGPDICGSQTKKIHAIILYKSKNHQMKKTVECETDKLSHVYTFIIRPDATYSILVDNKEKESGSLYKDWDLLPPRKIKDLSAKKPEDWDDNEFIPDPEDHKPEGYDSIPKEIPDLDAKKPEEWDDESDGEWEAPLIPNPEFKGPWTPKEIKNPNYNGKWKAPLISNPEFEEDPDLYVLPPLKYFGMELWQVKAGSVFDNILVTDDPEYAKKFAEETWGNIKEGEKEMFDELENKNREEQKIDDNDPNEEKDDYDEDDDDDDHDEL

SEQ ID NO: 218 - DNA, 1385 bp, Populus trichocarpa
actggcacttggcgaactggtttaccagaaatggagaagaagctaagactacatgtcgttcaagccttaaagctactatttttgcttttcactatccactgtctcttcctcttccctgtcactctctctgaaatcttctttgaagaacgttttcaagatgggtggaaagatagatgggttttatcagactggaaaagaagtgaaggcaaagctggtacttttaagtacacagcagggaaatggcctggcgatccagatgataaaggtattcaaacatataatgatgcaaagcattttgctatatctgcaaagatatcacctgagtttagtaacaagaatagaactttagtagttcagtattctattaagtttgagcaagaaattgagtgtggtggtgggtatattaagctgttttctggttatgttaatcagaagaaatttggtggtgatactccttatagttttatgtttggacctgatatatgtgggactcaaacaaagaagcttcatgttatcatgtcttaccaaggacagaattatccaatcaagaaggatttgcaatgtgaaactgataagttgactcatttctatacatttattcttagacctgatgcatcttacagtgtgttggttgataatagagagagggaatcaggaaccatgtatacagattgggatatacttcctccgccgaaaatcaaagataccaaagcaaagaggccggcggactgggatgatagggaatatattgaggatcctaatgatgtcaaaccagagggatatgattctatcccccgggagattcctgatcctaaggctaaagagcctgataattgggatgaagaggaggatggaatatggaggccacccaagataccaaatccagcttacaaaggaccatggaaaagaaagaaaatcaagaaccccaactataaaggaaaatggaagactccatggatcgataacccagagtttgaagatgatcctgacctttatgtgctaaagcccataaagtatgtgggtattgaagtttggcaggtgaaggctggttcaatttttgacaatatattgatctgtgatgacccacaatatgcgagagaaattgtgaaagatgtattccagaatagagagatcgaaaaagatgcctttgaggaagcagagaaagtgagaagagctcgagaagaagaggaagctcagagagctagagaggaaggtgaaaagaggaggaaagaaaggggctacaggaagcctcgtagaaggcacgatcctcgggattacttggatgattaccatgatgaactataagctttccatggctggttccatctgtgtcttgcaactgaaagagataccaagtttcagatttctgaaggcagcattgcctg

SEQ ID NO: 219 - protein, 424 aa, Populus trichocarpa
MEKKLRLHVVQALKLLFLLFTIHCLFLFPVTLSEIFFEERFQDGWKDRWVLSDWKRSEGKAGTFKYTAGKWPGDPDDKGIQTYNDAKHFAISAKISPEFSNKNRTLVVQYSIKFEQEIECGGGYIKLFSGYVNQKKFGGDTPYSFMFGPDICGTQTKKLHVIMSYQGQNYPIKKDLQCETDKLTHFYTFILRPDASYSVLVDNRERESGTMYTDWDILPPPKIKDTKAKRPADWDDREYIEDPNDVKPEGYDSIPREIPDPKAKEPDNWDEEEDGIWRPPKIPNPAYKGPWKRKKIKNPNYKGKWKTPWIDNPEFEDDPDLYVLKPIKYVGIEVWQVKAGSIFDNILICDDPQYAREIVKDVFQNREIEKDAFEEAEKVRRAREEEEAQRAREEGEKRRKERGYRKPRRRHDPRDYLDDYHDEL

SEQ ID NO: 220 - DNA, 1530 bp, Poncirus trifoliata
cttaaaactacaagccacaaggatcctaaagatgatgcttaagctgcttgtacttttccttttctttcaaatttcagtttctgagatcttttttgaagagcgatttgacgatggatggcgaagtcgttgggtaatatcagactggaaaagaagtgaagggaaagcgggatattttaagcacacagctggaaagtggcatggtgacccagatgataaaggtattcaaactcacaccgatgcaagacactatgccatatctgcaaaaataccagaatttagcaacaaaaacagaacattggttgtccagtattctatacgatttgagcaagacattgaatgtggtggtggatacctaaaacttctttctgcatatgtcaatcaaaagaaatttggtggagatgctccctacagtttaatgtttggaccagatatatgtggcacgcaaaagaagcatctccatgttatcctctcctaccagggtcagaattaccccatcaaaaaggagttggaatgtgaaacagacaagttgactcatttctacacatttattctcaggcctgatgccagttatagtatcctcattgataaccgagaaagggattctggtagcatgtacacggattgggatattcttcctccacggaaaatcaaagctgttaatgccaaaaagccagcggattgggatgatagagaatatattgatgatcctaatgccgtcaaaccagagggatatgattcaattccaaaagaaattccagacccgaaagctaaaaagcctgacaattgggatgaagacgaggatggcctatggaaaccaccaaagataccaaatcccgcatataaaggactatggaggcctaagaggatcaagaacccgaactataaaggaaagtggaagatcccttacattgacaatccagagtttgaagatgatcccgatctttacgtgcttaagccaattaagtatgtaggcattgaagtttggcaggtcaaggctggttcagtttatgacaacattttgatctgtgatgatcctgcatatgcaaaacaagtggtcgaggaagtactttctaacagggagattgaaaaagagggttttgaggaagcagagaaagtgagaaaagtgcgagaggaagaggaagctcaacgagcacgagaggaaggtgaaaagaggagaagagagaggggttatgatcgaagaagatatagggatcgctacagagataaataccgaaggcatgattacttggacgatgattatcatgatgagctatgaggcagagatccctcactggcattacttcacctgccctcctcagtggtgccatcgccttttatgtgaaggattgatgcttgcaactgctataaatcagtagcattcgcccttgaagttgtatttttggctctgataattgtagtattatttggaggcaacactccagcatttctagataccgaactagttgaagtttgtttttattgtatggtgcatgctttactttggaattaattaaaacacttttttttttt

SEQ ID NO: 221 - protein, 414 aa, Poncirus trifoliata
MMLKLLVLFLFFQISVSEIFFEERFDDGWRSRWVISDWKRSEGKAGYFKHTAGKWHGDPDDKGIQTHTDARHYAISAKIPEFSNKNRTLVVQYSIRFEQDIECGGGYLKLLSAYVNQKKFGGDAPYSLMFGPDICGTQKKHLHVILSYQGQNYPIKKELECETDKLTHFYTFILRPDASYSILIDNRERDSGSMYTDWDILPPRKIKAVNAKKPADWDDREYIDDPNAVKPEGYDSIPKEIPDPKAKKPDNWDEDEDGLWKPPKIPNPAYKGLWRPKRIKNPNYKGKWKIPYIDNPEFEDDPDLYVLKPIKYVGIEVWQVKAGSVYDNILICDDPAYAKQVVEEVLSNREIEKEGFEEAEKVRKVREEEEAQRAREEGEKRRRERGYDRRRYRDRYRDKYRRHDYLDDDYHDEL

SEQ ID NO: 222 - DNA, 1785 bp, Sorghum bicolor
accgagagtggtaggaaagctcgtcgccgtacggggctcggctcaggtgagagcgagcgtcgggtactgaggccggaggcgatgccgatgggccgcctccgcgacgggcgagccttcctccaccgcgcgctggtcctctcgtcgctgctgctcctcgcctcgggcgaaatcttcttcgaggagcggttcgatgatggttgggatagccgttgggtgaaatctgattggaagaagagccaaggacaaaccggaaccttcagacacacagcaggaacctattctggagatcctgacgataaaggtatacaaacaactggggatgccaaacattttgctatatcggcaaaattcccagaatttagtaacaaggaccggacattggtgatccagtactctctaaagattgagcaagacattgaatgtggtggtgcttacatcaaacttatgtctggttatctcaaccagaagaagtttggcggcgacactccttacagcttcatgtttgggcctgatatatgtggggatcagaaaaagaagcttcatctcatactttcataccaagggcaaaactaccctatcaagaaagatctaaaatgcgaagcagacaagttgacacatttttacacatttattctaagacctgatgccacttatagcatccttattgataaccgggagagagaatttggaagcatgtacactgactgggatatccttcctcctcgtaagatcaaagatgttaatgcgaaaaagccaaaagactgggatgacagggaatatattgaagatcctgatcaagttaagccagagggatatgattcaattcctaaacagatacctaatccaaaggacaaaaagcctgagtcatgggatgatgacgaagacggtacatggaagcccagaatgatacctaatccagaatacaagggaccatggaagcggaagaaaattaagaatcctaactacaaaggaaaatggaagaccccgtggattgacaatccagagtttgaggatgacccagacctatatgttttgaaacctttgcagtatgtggggattgaagtctggcaggtcaaagctggttcggtttttgacaacattttgatttgcgatgatccagactatgcaagacatgttgtagatgaaacttttgctgcaaataaggaggctgaaaaagaggcctttgaaggagctgaaaggaagaggaaggctagagaagaagaggaagcacggcgagcacgggaggaaggggagagacgaaggcgggagagggatagggaccgtggcagggaccgttacagggatagatataagcgccatagacactacgactaccatgacgagctatagatcatgtgttttgaaatctgcacgttattggttgtctatggaactgggccttgatgattgtgtcaataaggtgtaccacttcagggcgagcacagatgtttgaagtccttaaccgtactgttacagtcgttgagagcacacgcacacgtgcagaacttgtatgttgtacacacgaatcaagctgaatttgtgatttttggcgatgggtagagattgaccatcgcggctgtaactaaatttccccattgcgaggcaatatgagctgtagtatccttgcactatcatttacctcgaaatgttatattcgtgctgcatacgttgataaacctttcattgtcaggagtcgggacaaggaaaaacacgaaatggccctagtcactcaactttttacgacttaaaatgactagtgtgcccgaatcagaatccttttatatt

SEQ ID NO: 223 - protein, 422 aa, Sorghum bicolor
MPMGRLRDGRAFLHRALVLSSLLLLASGEIFFEERFDDGWDSRWVKSDWKKSQGQTGTFRHTAGTYSGDPDDKGIQTTGDAKHFAISAKFPEFSNKDRTLVIQYSLKIEQDIECGGAYIKLMSGYLNQKKFGGDTPYSFMFGPDICGDQKKKLHLILSYQGQNYPIKKDLKCEADKLTHFYTFILRPDATYSILIDNREREFGSMYTDWDILPPRKIKDVNAKKPKDWDDREYIEDPDQVKPEGYDSIPKQIPNPKDKKPESWDDDEDGTWKPRMIPNPEYKGPWKRKKIKNPNYKGKWKTPWIDNPEFEDDPDLYVLKPLQYVGIEVWQVKAGSVFDNILICDDPDYARHVVDETFAANKEAEKEAFEGAERKRKAREEEEARRAREEGERRRRERDRDRGRDRYRDRYKRHRHYDYHDEL

SEQ ID NO: 224 - DNA, 1679 bp, Triticum aestivum
agaagcagcagcctggctggcagccaccagcccaccaccacttcctcgtctccggcgagccaccgacgatgggtagcagccgccggcggggcgaccgccacctcaagctcctgcaccgactcctcgccctctcgtcgctgctcctgctcgcctccggggaggtcatcttcgaggagcgattcgaagatggttgggagactcggtgggtcaaatccgattggaagaagagcgaagggaaagccggcatgttcaagcacacggcaggaaaatattctggagatcctgatgacaaaggcattcaaacaacaatagatgctaggcattttgccatctcagccaagatcccagagttcagtaacaagggccggacattggtagtccagtactccataaagtttgagcaggaaattgaatgtggtggcggctatattaagctaatgtctggctacgtcaaccagaagaaatatagcggagacactccttacagcttgatgtttgggccagatatatgtgggactcaaacaaagaagctgcatcttatactctcttaccaggggcagaactaccctatcaagaaagatctacaatgcgaaaccgacaggctgacgcatgtttacacattcattcttaggcccgacgcatcttatagtttacttgttgataaccgtgaaagagaatctgggagcatgtacactgattgggacatcttgcctcctcgtaaaattaaggatgttggtgccaaaaagcctaaggattgggatgacagagagtacattgaggatccagatgcggttaaacctgagggatatgattctattccaagagagattcctgacccaaaggataaaaagcccgacacatgggacgatgatgatgatggcatatggaaacctagaaggataccgaatccagcatacaaaggacagtggaagcgcaagaaaattaagaaccctaactacaagggtaaatggaagatcccatggattgataatccagagtttgaggatgatccagatttatatgtactgaaacctctgaagtatattggaattgaagtttggcaggtaaaagccggctcagtatttgacaacattctcatttgcgatgacccggaatatgcaaaacaggttgccgatgaaacatggggtgcaaataaggaggctgaaaaggaggcttttgaagaagctgaaaaggagaggaaagctagagaagataaggaagctcaacaagcaagggaggaaggagagcgacggaggagagagaggggtgatcgacaccgtggtagggaccattacaaggacagatacaaaagacgcaacagagatcactgggatgactaccatgatgagctttgaagccccccaaaatcttcaattcttccaaggagaaactgggttttgacacagacattgtgttatagttgcttcaaataaatgataattgaagtgtttcttgtctcgtgtgagggaaactgattgaattgaccacgaagatcattcctatgtaacagcaggacagacaattccacttatcctggaaagtaaaaaatcttggccttggccctgaaatgcgatgttgtgtgtgtagtgtacatggtcggtgatgtacttcctttttgtaaactcagaacattacctttgctgatataataaagaggttccatatttattgcataacac

SEQ ID NO: 225 - protein, 428 aa, Triticum aestivum
MGSSRRRGDRHLKLLHRLLALSSLLLLASGEVIFEERFEDGWETRWVKSDWKKSEGKAGMFKHTAGKYSGDPDDKGIQTTIDARHFAISAKIPEFSNKGRTLVVQYSIKFEQEIECGGGYIKLMSGYVNQKKYSGDTPYSLMFGPDICGTQTKKLHLILSYQGQNYPIKKDLQCETDRLTHVYTFILRPDASYSLLVDNRERESGSMYTDWDILPPRKIKDVGAKKPKDWDDREYIEDPDAVKPEGYDSIPREIPDPKDKKPDTWDDDDDGIWKPRRIPNPAYKGQWKRKKIKNPNYKGKWKIPWIDNPEFEDDPDLYVLKPLKYIGIEVWQVKAGSVFDNILICDDPEYAKQVADETWGANKEAEKEAFEEAEKERKAREDKEAQQAREEGERRRRERGDRHRGRDHYKDRYKRRNRDHWDDYHDEL

SEQ ID NO: 226 - DNA, 1278 bp, Vitis vinifera
atggggttccttagcaatagtagtgggtttagtgatatgctcaagaagcttttgctactgccactgctcctttcctttctcctcactttctcactatctgaggtcatttttgaagagagattcgaagatgggtggcagagtcggtgggttaaatcagattggaagaaaagtgaagggaaggcaggatcatttaagcacacggctggcaagtgggctggagatccagatgataaaggtatccagacatctacagatgcaaggcacttcgccatatctgctaagattccagagttcagcaacaagaacagaacattggtactccagtattctataaggtttgaacaggaaattgaatgtggtggtggttacataaaacttctttctggatttgtcaatcagaagaaatttgggggtgacactccttacagtgtaatgtttggaccagatctatgtggtacacaaacaaagaagctccatgttatagtctcctaccagggccagaattaccctatcaagaaggatctgcaatgtgaaacggataagttaacacatttctacacattcattcttaggcctgatgcatcgtatagcgtcctgattgacaatcgagagagagaatccggaagcatgtattctgattgggatatcctcccccctcgaaagattaaagacaccaaggcaaaaaagcctgcagactgggatgacagagaatatattgaagatcctaatgatgtcaaacctgagggttacgattcaattccagctgaaattcctgatccaaaagctaaagagcctgataattgggatgaagaagaggatggtttatggaaaccaccaaaaataccaaatccagcattcaaaggaccatggaggcggaagaaaattaagaatcctaactacaaggggaagtggaagaatcaatggatcgacaatcccgaatttgaagatgaccctgatctttatgtactaaagccaattaaatatgtgggcattgaagtgtggcaggtgaaggctggtgcaatttatgacaacattttgatttgtgatgatccagagtatgcaaaacaagttgtggaggaagtatttgcccatagggagtctgaaaaagaggcatttgaggaagcagaaaaagtgagaaaagcacgagaggaagaggaagctcaaagagcaagagaggaaggtgaaagaaggagaagggagcggggccatgatcgacgttatcgagatagggagcgatacagagacagatatagaagggtttgtatctcatatgcttga

SEQ ID NO: 227 - protein, 425 aa, Vitis vinifera
MGFLSNSSGFSDMLKKLLLLPLLLSFLLTFSLSEVIFEERFEDGWQSRWVKSDWKKSEGKAGSFKHTAGKWAGDPDDKGIQTSTDARHFAISAKIPEFSNKNRTLVLQYSIRFEQEIECGGGYIKLLSGFVNQKKFGGDTPYSVMFGPDLCGTQTKKLHVIVSYQGQNYPIKKDLQCETDKLTHFYTFILRPDASYSVLIDNRERESGSMYSDWDILPPRKIKDTKAKKPADWDDREYIEDPNDVKPEGYDSIPAEIPDPKAKEPDNWDEEEDGLWKPPKIPNPAFKGPWRRKKIKNPNYKGKWKNQWIDNPEFEDDPDLYVLKPIKYVGIEVWQVKAGAIYDNILICDDPEYAKQVVEEVFAHRESEKEAFEEAEKVRKAREEEEAQRAREEGERRRRERGHDRRYRDRERYRDRYRRVCISYA

SEQ ID NO: 228 - DNA, 1677 bp, Zea mays
agtggtaggaaaagctcgtcgccgagtcgccgtacgggggctcggctcgggtgagcgagcggcgggtactgaggcctgagggcgaggcgatgggccgcctccgcgacgggcgagccttcctccaccgcgcgcttgtcctctcgtcgctgctccttctcgcctccggcgaaatcttcttcgaggaacggttcgatgatgggtgggatagccgctgggtgaaatctgattggaagaagagccaaggacaagctggaaccttccgacacacagcgggaacctactctggagaccctgacgataaaggtatacaaacaactggggatgccaaacattttgctatatcagcaaaattcccacaatttagtaacaaggaccggacattggtgatccagtactctctaaagattgagcaagatattgaatgcggtggtgcttacatcaaacttatgtctggttatctcaaccagaagaaatttggtggcgacactccttacagcttcatgtttgggcctgatatatgtggggatcagaaaaagaagctccatctcatactttcataccaagggcaaaactaccctatcaagaaagaactaaaatgtgaaacagacaagttgacacatttttacacatttattcttagacctgatgccacttatagcatccttatcgataaccgggagagagaattcgggagcatgtacactgactgggatatccttcctcctcgtaagatcaaagatgttaatgcaaaaaagccaaaagactgggatgacagggaatatattgaagatcctgatcaagttaagccagagggatatgattcaattcctaaagagatacctgatcccaaggacaaaaagcctgagtcatgggatgacgatgacgatggtacatggaagcctagaatgatacctaatccagaatacaagggaccatggaagcggaagaaaattaagaatcctaactacaaaggaaaatggaagaccccatggattgtcaatccagagtttgaggatgacccagacctatatgttctgaaacctttgcagtatgtggggattgaagtatggcaggtcaaagctggttcagtttttgacaacattttgatttgcgatgacccagactatgcaagacatgttgtagatgaaacttttgctgcaaataaggaggctgaaaaggaggcctttgaaggagctgaaagaaagaggaaggctagagaagaagaggaagcacggagggcacgggaggaaggggagagacgaaggcgggagagggatagggaccgcggcagggaccgatacaaggatagatataagcgtcataggcactacgactaccatgacgagctatagatcatgtattcttttgaaatctgcacgatattggatgtctgtctacggagagcgcacgtgcaaaacttgtatgttgtactcacggatgaagacctgtgattttggcgatgggtagagattggccatcgcgtccgtaactaaatttccccgttgcgatgcaatatgagctgtagtactgtcctcgcactattatttaccgtttgtgatgcatatgtgatataaaccttcaagaaacacacacacgaagggtctgaatgagcacggcctttgttgtttgcttcttatcaaaaagaactgttttatctgtgtataacaaaaaaaaaaa

SEQ ID NO: 229 - protein, 420 aa, Zea mays
MGRLRDGRAFLHRALVLSSLLLLASGEIFFEERFDDGWDSRWVKSDWKKSQGQAGTFRHTAGTYSGDPDDKGIQTTGDAKHFAISAKFPQFSNKDRTLVIQYSLKIEQDIECGGAYIKLMSGYLNQKKFGGDTPYSFMFGPDICGDQKKKLHLILSYQGQNYPIKKELKCETDKLTHFYTFILRPDATYSILIDNREREFGSMYTDWDILPPRKIKDVNAKKPKDWDDREYIEDPDQVKPEGYDSIPKEIPDPKDKKPESWDDDDDGTWKPRMIPNPEYKGPWKRKKIKNPNYKGKWKTPWIVNPEFEDDPDLYVLKPLQYVGIEVWQVKAGSVFDNILICDDPDYARHVVDETFAANKEAEKEAFEGAERKRKAREEEEARRAREEGERRRRERDRDRGRDRYKDRYKRHRHYDYHDEL

SEQ ID NO: 230 - DNA, 1795 bp, Zea mays
  misc_feature (1750)..(1750): n is a, c, g, or t
caacttgcacgctccggcagcgaagctcccccctccctgcctccttccccggcgccccgctcttcctccttccgctccggcgatgggcactggccgccgcggcggcggcggcggcggcgtgttccaccgcctcctcgccctctcgtcgctgctgctcctcgcttccggcgaggtcgtcttcgaggagcgcttcgaagatggttgggagactcggtgggtggaatccgactggaaaaggagtgaagggaaagcaggaaggttcaagcacacagcggggagatactctgcagatcctgatgacaaaggaatacaaacaacaatagatgccagacattttgctatctcagccaagttcccggaattcagtaacaagaaccggacgcttgtggtccagtactccattaagtttgagcaggatattgaatgtggcggtggctatattaagcttatgtccggttatgtcaaccagaaaaaatttagtggggacactccgtacagcttgatgtttggaccagatatatgtggtactcaaacaaagaagctccatcttatactctcttaccaggggcagaactatcccatcaaaaaagatctagaatgtgagacggacaagttaacacacgtgtatactttcattcttaggcctgatgcatcttatagcctgcttgttgataaccgtgaaagagaatctgggagcatgtacactgattgggatattctccctcctcgtaaaattaaggatgttcacgccaaaaggcctaaggattgggatgacagagaatatattgaagatcctgatgaagttaagccagagggctatgattctatcccaaaacagattcctgatccgaaggacaaaaagcctgacacatgggatgaagatgaggatggaatatggaagcccagaatggtatcaaatccagcatacaagggaccttggaaacgcaagagaattaaaaatcctaactacaagggtaaatggaagaccccatggatcgataatccagagtttgaggatgatccagatctttatgtgctgaagcctttgaagtatattggaattgaagtttggcaggtaaaagctggttcagttttcgacaacattctgatttgtgatgaccctgagtatgcaagaaaggttgttgaggaaacttggggtgcaaatagggaggctgaaaaggaagcttttgaagaagctgaaaaggagaggaaagctagggaggatagggaaggtcaaaaggcaaaggacgatggtggccggcatcgaatacacaggcgtcataaaaaacactacagagatcactgggacgactaccatgatgagctataaaagtccccaaatattgcattcctcaaaagcataagctggaagttgcttcggacattgtgggtgcttttcaataataataattgattcgcctggtcagaacaacctgaagtgtttcttgctatgcgccaacaaattattgaactacaggatttgatatgtaatggacaaccgaagatctgcagggcattccagcgaaaacttggctctggtactgaaatagaggggacgagagactgtagtttgtgtctgtacaacggtgccggccatgtgctagctttgtaatctcaaaacattgtctttgcatgaataatgtaagttacccaaaaattactgcataccaagttacaaagtgttgtagctgacatatgaggaacactttaattttaatcttcatatatatacttctgtaatcttcaaaanaggatacgatgcaattggtctatcatcaccttgcataaagaacaa

SEQ ID NO: 231 - protein, 415 aa, Zea mays
MGTGRRGGGGGGVFHRLLALSSLLLLASGEVVFEERFEDGWETRWVESDWKRSEGKAGRFKHTAGRYSADPDDKGIQTTIDARHFAISAKFPEFSNKNRTLVVQYSIKFEQDIECGGGYIKLMSGYVNQKKFSGDTPYSLMFGPDICGTQTKKLHLILSYQGQNYPIKKDLECETDKLTHVYTFILRPDASYSLLVDNRERESGSMYTDWDILPPRKIKDVHAKRPKDWDDREYIEDPDEVKPEGYDSIPKQIPDPKDKKPDTWDEDEDGIWKPRMVSNPAYKGPWKRKRIKNPNYKGKWKTPWIDNPEFEDDPDLYVLKPLKYIGIEVWQVKAGSVFDNILICDDPEYARKVVEETWGANREAEKEAFEEAEKERKAREDREGQKAKDDGGRHRIHRRHKKHYRDHWDDYHDEL

SEQ ID NO: 232 - DNA, 2279 bp, Chlamydomonas reinhardtii
cggccctcctggaagatctgagcaccagccttgaaccacacggcctcgccgaagggcacgccgtaggagcccagcagctcggggaagatgcagcccagagcgccgagcatggcccagcgggcgtggatcagctccagctcgcggtagcgcttgaaggtctccgggtcagcggacaggccggcggtgtcccagccgtagtcaccggggaactcgccagtcaggtagctcgggggctcgccagtgaactcgccttcacatacctcacggctacggccggcaagaacctgccttgctagtcgtttattgatcctcaaatgaagtggggtgtggttgcggtgctggccaccctggtggtggccgcgtccgccaaggactacttcaaggagaccttcgatggctcctgggccgaccgctggaccaagtcctcttggaaggtttctgatgggtccgctggcgagttcaagctgaccgctggcaagtggtatggcgacgctgaggccgacaagggtatccagaccggccccgactccaagttcttcgctatttccgcgcccctggccaccgtgttcgacaacaccggcaaggacaccgttgtccagttctccgtcaagcatgagcaggacctggactgcggtggtggctacatcaaggtggtgcccgctaccagcgagaagcagatgggcgagttcggtggcgacaccccctactccatcatgttcggccccgacatctgcggctactcgacccgcaaggtgcacgtcatcctgacctacaagggcaagaactacctgattaagaaggacatcaaggcggagactgaccagctgacccatgtgtacaccctggtcatcaagcccgacaacacctaccaggttctgattgacctgaaggaggtcgcctcgggctccctgtacgaggactgggacatgctgccccccaagaccatcaaggaccccaaggcctccaagcctgaggactgggacgagcgtgaggagatcgccgaccccgaggacaagaagcctgagggctgggacgacatccccgccaccattgccgacaaggacgccaagaagcccgaggactgggacgacgaggaggacggcacctgggagccgcccatgatccccaaccccgagtacaagggtgagtggaaggccaagatgatcaagaaccccgcctacaagggcatctgggtcgcccccgacattgacaaccctgactacgtccacgacgacaagctgtacaacttcaaggacctgaagtttgtgggcttcgagctgtggcaggtcaagtcgggctccatcttcgacaacatcctggtgactgacgacctggaggccgccaagaagttcgctgaggacacctggggcaagcacaaggacgaggagaaggccatgtttgacaaggtcaagaaggaagaggacgagaagaaggccaaggacgccccccctccccctgtcgacgctgaggccgccgaggaggaggacgacgagtacgaggacaggcacgaggcctccggcatgggctccatcaagatccccaaggaggaggaggagtccggtcacgacgagctgtaagcggctcgctgcgaggacttcccttccaacgcaggacgagaccagcagctgccgcgtcagcagtggagttgtgggcgcgcgcgtgagcggcgtttgtggagcgccaatcacgtggctatggtcggctcctgaggtggattaggtggcatagtgatgttagatcggacgcgttagaagcggtcggggcatggtggggctgtgcccctccgcgggcacgggaagtgcgacacgcccggcggctgcatgtggagcgtgcggcgtagaggggcatgctggttcccgctccggcgtttccgtggagcgtgtcgggtgcatgacctgcctggcgggggccccccaacaccacgtttctcgagccgaacgcttgtgacctgtgtcaactggtgtgggttggcgcagcggcctccgcaaggagtgtcgcggcgccgttgtgtcgtggggggacgtaacatcccctggttggggagattttgctgaccacacggcgatgctgagagttcgagagagatgagcgagcatgctaggaagattaggatccttaggcaggatgttcagtacaggagcacataaggcgagcaacgtcgcggggtgtgtcgtctcggaggaatgagggcgagtgagttgtgagcagcccctgccagtggatgaaggggtggggctgggacccatcggtcgtgtaaccagcccagcatatcaaaaaaa

SEQ ID NO: 233 - protein, 420 aa, Chlamydomonas reinhardtii
MKWGVVAVLATLVVAASAKDYFKETFDGSWADRWTKSSWKVSDGSAGEFKLTAGKWYGDAEADKGIQTGPDSKFFAISAPLATVFDNTGKDTVVQFSVKHEQDLDCGGGYIKVVPATSEKQMGEFGGDTPYSIMFGPDICGYSTRKVHVILTYKGKNYLIKKDIKAETDQLTHVYTLVIKPDNTYQVLIDLKEVASGSLYEDWDMLPPKTIKDPKASKPEDWDEREEIADPEDKKPEGWDDIPATIADKDAKKPEDWDDEEDGTWEPPMIPNPEYKGEWKAKMIKNPAYKGIWVAPDIDNPDYVHDDKLYNFKDLKFVGFELWQVKSGSIFDNILVTDDLEAAKKFAEDTWGKHKDEEKAMFDKVKKEEDEKKAKDAPPPPVDAEAAEEEDDEYEDRHEASGMGSIKIPKEEEESGHDEL

SEQ ID NO: 234 - DNA, 1843 bp, Volvox carteri
attggcgaatagtttccttaggtggtcaggtttggccttagtattttattatacagacaggctgccttgcctgagtcggtgtagtgatctgctgcccgtaacaatgaaggtggcgttcctgttggccaccttggcggtggccgcaagcgccgaggtctaccttaaggaaacctttgatgattcctgggcggatcgttgggtgaagtctaagtggaagcagagcgagggtcaagctggcgattttacgctcagcgccgggaaatggtatggcgacgctgaggcggacaagggtatccagacgggaccggactccaaattctttgcgacttatgcgaccttggacaaggtcttcgacaacactggcaaggatacagttgtgcagttctcggtgaagcatgagcaagacctggactgcggaggcggttacattaagctgattccagcttccagcgagaagcagatggagtccttcggcggtgagacaccctactccgtcatgttcggtcctgatatttgcggctactctactcgcaagattcatgtcattcttacttacaagggtaagaattacttgatcaagaaggacctgaaggcggagtctgatcagctgacgcacgtttacaccctggtgattaagcccgacaacacttacaaggtttacgtcgacctgaaggaggttgcctcgggctctctcttcgaggactgggacatgctgcctccaaagactgttaaggaccctaaggccaagaaacctgaggactgggacgagcgtgaggagattgcggatcccgaggacaagaagcccgatggctgggatgacatccccgctaccatcccggataagactgccactaagccggatgactgggatgacgaggaggacggcgcctgggaggctccaaccatcccgaaccctgagtacaagggcgagtggaaaccgaagatgattccgaaccctgcctacaagggcaaatgggttgcccctgacattgataaccccgagtacgtccacgatgacaccctctataacttcaaggacctcaaattcgtgggcttcgagctctggcaggtgaaatcgggctccatcttcgataacatcattgtcacagatgacttcgatgttgctaaggcttttgctgaggagacctggcagaagaccaaggatgctgagaaggagatgtttgataaggtaaagaaggaggaggacgagaagaaggcgaaggaggccccgccgccatcttccgaggagcctgccgaggaggacgaggacgatgagtacgaggactccaaggaggagccggctcacgtcggcaccattaagctgccggatgaggaggagtccagtggacatgatgaactctagactgagcgagacttctttaggatagatgttctgctcgcgtggggcttgcttgggcacatgaccgtgttagatagacgtgaccattcgtgacctgactcttaagctaacgagaaatgggagaccgatgacttgatttaggcaggatgactgttcgggcaggcgctcggtagacgaaggatgtaaaactttgcttacattaagattgacaatatgaaagccatgcgtgtgtatatttgatctgcagtggggtagtcgcatgcgatcgcggctcggcgaaaatctgctgcgttgtgatagcgtcggaagactgcactgtaatgatcaccgtacattgtgtgcaagaaaaggagtgggcagtgggacagaggatccagaacaccaactcgagagccaatgtcattccggcatttggtacggcagtgccatggtgtacggaaactgctcacctctgcggagaagtattttaatagcacgtggttg

SEQ ID NO: 235 - protein, 419 aa, Volvox carteri
MKVAFLLATLAVAASAEVYLKETFDDSWADRWVKSKWKQSEGQAGDFTLSAGKWYGDAEADKGIQTGPDSKFFATYATLDKVFDNTGKDTVVQFSVKHEQDLDCGGGYIKLIPASSEKQMESFGGETPYSVMFGPDICGYSTRKIHVILTYKGKNYLIKKDLKAESDQLTHVYTLVIKPDNTYKVYVDLKEVASGSLFEDWDMLPPKTVKDPKAKKPEDWDEREEIADPEDKKPDGWDDIPATIPDKTATKPDDWDDEEDGAWEAPTIPNPEYKGEWKPKMIPNPAYKGKWVAPDIDNPEYVHDDTLYNFKDLKFVGFELWQVKSGSIFDNIIVTDDFDVAKAFAEETWQKTKDAEKEMFDKVKKEEDEKKAKEAPPPSSEEPAEEDEDDEYEDSKEEPAHVGTIKLPDEEESSGHDEL

SEQ ID NO: 236 - DNA, 1221 bp, Drosophila melanogaster
atgatgtggtgcaaaacagtgatagtgttgctggcgacagtcggctttattagtgccgaggtttatctgaaggagaatttcgacaacgaaaactgggaggatacgtggatctacagcaaacatcctggcaaggagttcggaaaattcgtcctcacccccggtaccttctacaacgatgctgaggccgacaaaggcattcagacctctcaggatgctcgattctacgcggccagccgcaagtttgatggcttctccaacgaggacaagcccctcgtggtgcagttctccgtgaagcacgagcagaatatcgactgcggcggcggctatgtgaagctgttcgactgctccctcgaccagaccgacatgcacggcgagtcgccgtacgagatcatgttcggcccggacatctgcggacccggcaccaagaaggtccatgtgatcttcagctacaagggcaagaaccacctaatcagcaaagacatccgctgcaaagatgacgtgtacacccacttctacacgctgattgtcagacccgacaacacgtacgaggtgctcatcgacaacgagaaggtggagtctggcaacctggaggacgactgggacttcctggcccccaagaagatcaaggatcccaccgccaccaagcccgaagactgggacgatagggccaccattcccgatcccgatgacaagaagcccgaggactgggacaaaccagagcacattcccgacccagatgccacaaagcctgaggattgggacgatgagatggacggcgagtgggagccaccgatgatcgacaaccctgagttcaagggcgagtggcagccaaagcagctggacaaccccaactacaagggcgcctgggagcatcccgagatcgccaatcccgagtatgtgcccgacgacaagctgtatctgcgcaaggagatctgcaccctgggcttcgatctctggcaggtcaagtccggcactatcttcgacaacgtcctgatcacggacgacgtggagctggccgctaaggctgctgccgaagtcaagaacacccaggcgggcgagaagaaaatgaaggaggcccaggatgaggtgcagcgcaagaaggacgaggaggaggcgaaaaaggcttccgacaaggacgatgaggacgaggatgatgacgatgaggagaaggatgatgaatctaagcaagacaaagatcaaagcgaacacgacgaattgtaa

SEQ ID NO: 237 - protein, 406 aa, Drosophila melanogaster
MMWCKTVIVLLATVGFISAEVYLKENFDNENWEDTWIYSKHPGKEFGKFVLTPGTFYNDAEADKGIQTSQDARFYAASRKFDGFSNEDKPLVVQFSVKHEQNIDCGGGYVKLFDCSLDQTDMHGESPYEIMFGPDICGPGTKKVHVIFSYKGKNHLISKDIRCKDDVYTHFYTLIVRPDNTYEVLIDNEKVESGNLEDDWDFLAPKKIKDPTATKPEDWDDRATIPDPDDKKPEDWDKPEHIPDPDATKPEDWDDEMDGEWEPPMIDNPEFKGEWQPKQLDNPNYKGAWEHPEIANPEYVPDDKLYLRKEICTLGFDLWQVKSGTIFDNVLITDDVELAAKAAAEVKNTQAGEKKMKEAQDEVQRKKDEEEAKKASDKDDEDEDDDDEEKDDESKQDKDQSEHDEL

SEQ ID NO: 238 - DNA, 1155 bp, Homo sapiens
atggcccgggctttggtccagctctgggccatatgcatgctgcgagtggcgctggctaccgtctatttccaagaggaatttctagacggagagcattggagaaaccgatggttgcagtccaccaatgactcccgatttgggcattttagactttcgtcgggcaagttttatggtcataaagagaaagataaaggtctgcaaaccactcagaatggccgattctatgccatctctgcacgcttcaaaccgttcagcaataaagggaaaactctggttattcagtacacagtaaaacatgagcagaagatggactgtggagggggctacattaaggtctttcctgcagacattgaccagaagaacctgaatggaaaatcgcagtactatattatgtttggacccgatatttgtggatttgatatcaagaaagttcatgttattttacatttcaagaataagtatcacgaaaacaagaaactgatcaggtgtaaggttgatggcttcacacacctgtacactctaattttaagaccagatctttcttatgatgtgaaaattgatggtcagtcaattgaatccggcagcatagagtacgactggaacttaacatcactcaagaaggaaacgtccccggcagaatcgaaggattgggaacagactaaagacaacaaagcccaggactgggagaagcattttctggacgccagcaccagcaagcagagcgactggaacggtgacctggatggggactggccagcgccgatgctccagaagcccccgtaccaggatggcctgaaaccagaaggtattcataaagacgtctggctccaccgtaagatgaagaataccgactatttgacgcagtatgacctctcagaatttgagaacattggtgccattggcctggagctttggcaggtgagatctggaaccatttttgataactttctgatcacagatgatgaagagtacgcagataattttggcaaggccacctggggcgaaaccaagggtccagaaagggagatggatgccatacaggccaaggaggaaatgaagaaggcccgcgaggaagaggaggaagagctgctgtcgggaaaaattaacaggcacgaacattacttcaatcaatttcacagaaggaatgaactttag

SEQ ID NO: 239 - protein, 384 aa, Homo sapiens
MARALVQLWAICMLRVALATVYFQEEFLDGEHWRNRWLQSTNDSRFGHFRLSSGKFYGHKEKDKGLQTTQNGRFYAISARFKPFSNKGKTLVIQYTVKHEQKMDCGGGYIKVFPADIDQKNLNGKSQYYIMFGPDICGFDIKKVHVILHFKNKYHENKKLIRCKVDGFTHLYTLILRPDLSYDVKIDGQSIESGSIEYDWNLTSLKKETSPAESKDWEQTKDNKAQDWEKHFLDASTSKQSDWNGDLDGDWPAPMLQKPPYQDGLKPEGIHKDVWLHRKMKNTDYLTQYDLSEFENIGAIGLELWQVRSGTIFDNFLITDDEEYADNFGKATWGETKGPEREMDAIQAKEEMKKAREEEEEELLSGKINRHEHYFNQFHRRNEL

SEQ ID NO: 240 - DNA, 1254 bp, Homo sapiens
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctttaa

SEQ ID NO: 241 - protein, 417 aa, Homo sapiens
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 242 - DNA, 1194 bp, Aureococcus anophagefferens
cgccgcagctgccaaaaaatcaccatgcgcgtcctcgccgcctccctcctcgccacggcgtcggccaaggtctacttcgaggacaacttcgacgcgggcatcggcgacaagtgggtgcccagcgagtggaaggacgccgagtcgacgggcaagtgggtgcacacggcgggcgagtggtacgccgagggccaggaggccatcgccaagggcatgcaggcgtccgaggacatgaagttccactccatctccgcgccgctcgattccgaggcgacgacggtgggcaagccgctcgtgatccagttcaccgtcaagcacgagaagaaggactacgcgttctgcggcggcggctacatcaagctcctgcccggcaaggtcgacgccaaggccttcgggggcgacacgccctacagcatcatgttcggcccggacctctgcggctacgacatctcgcgcgtgcacctcatcttcgagcacggcggcgagaacctgctcaaggaggaggagatcaagctcgactacgcggacaaggacgagttcacgcacctctacaccatggtcctcgaggccgacggctcctacgaggtcttcttcgaccaggtgtccaaggcgtccggcaagatcgtcgacgactgggcgttccccgacgcggaggtcaaggacccggccgtgtccaagcccgaggactgggtcgacacgaagaagatccccgacccggcggcggcgaagcccgagggctacgacgacatccccgcggagatccccgacccggacgcggagacgcccgaggactgggacgaggacgaggacggcgagtgggagccgccgatgatcgacaaccccgagttcaagggcgagtggaaggcgcccatgatcgagaacccggactacgtcggcgcctgggtccaccccatggtcgccaacgccgactacaagcccgagacctacgccaagtactccggcctgtccacggtcggcttcgagctctggacggtcaacgcgggctccatcttcgacaacatcctcgtcaccgacgacaaggcctacgcggacaaggccgccgaggccacgtggaagaagctcaaggacggcgacgagaaggccgccaaggacgcgtggaagaagctcaacgagcccgaggaggacgacgaggacgacgcggccgacgacgaggacgaggagcacgacgagctctag

SEQ ID NO: 243 - protein, 389 aa, Aureococcus anophagefferens
MRVLAASLLATASAKVYFEDNFDAGIGDKWVPSEWKDAESTGKWVHTAGEWYAEGQEAIAKGMQASEDMKFHSISAPLDSEATTVGKPLVIQFTVKHEKKDYAFCGGGYIKLLPGKVDAKAFGGDTPYSIMFGPDLCGYDISRVHLIFEHGGENLLKEEEIKLDYADKDEFTHLYTMVLEADGSYEVFFDQVSKASGKIVDDWAFPDAEVKDPAVSKPEDWVDTKKIPDPAAAKPEGYDDIPAEIPDPDAETPEDWDEDEDGEWEPPMIDNPEFKGEWKAPMIENPDYVGAWVHPMVANADYKPETYAKYSGLSTVGFELWTVNAGSIFDNILVTDDKAYADKAAEATWKKLKDGDEKAAKDAWKKLNEPEEDDEDDAADDEDEEHDEL

SEQ ID NO: 244 - DNA, 1173 bp, Phaeodactylum tricornutum
atgaagtttaccttgctgaccgttctggcggctgcagttgccgttcccgtcactgccgaagtttatctgaaggaacagttcaacgacgaggcatggacatcccgttggacggaatccaaggactggaagccggaaagcgatatgggtacctggaagcacaccgccggtgaatggtacagcgacgaagccgacaagggtattcagacgtcggtggacgctcgctttttcggcatttcggcacctctcgataaaccgtacacctcttccaaagacaaggacttggtcattcaatacagcgtcaaacacgaacaggatttggactgcggtggggcctacattaagctcttgccgggcggaaagtccttccagccagcggcctttgggggtgaatcaccctacgccgtcatgttcggaccggatatttgcggaagctccaacaagaaaactcacgttattctgcactccaaccaaaaggacgaaaacttgctgatcaacaagcaagtcatgtgtgaatccgatagcgttacccacctgtatactctggtggtccgtcccgacaacacctttgaagtctttgtggacaacaagtcggttcggagtggaaatctggcggacgaattcgatttcctggagcccaaagaaattaaggatcccgacgcccaaaaaccggaagactgggtggataaggccaagatcgccgaccccgaagacaaaaagccggagggctacgacgacatcccccaagaactccccgacccggacgcagtcaaaccggacgactgggacgacgaggatgatggcgagtgggaagcacccatgattgataatccggaatacaagggaccgtggaagccaaagatgatcgagaacccggactacaagggaccttgggttcatcccatggttcccaacccggactacaaggacgacgacgaaatgttcatggtctgcaaggacacatgcacacacgtaggattcgagctctggcaagtcaaaactggaactctgttcgacgatatcattgtgaccgatagcttagaagaagcacacgcatttgcgcaagaaaccttctttaagaagaaggatggagagaaggaaatgtacgacaagattcaagctgaacgacagccggagatgcccgatatggtaagtggcgagactctttcttactga

SEQ ID NO: 245 - protein, 390 aa, Phaeodactylum tricornutum
MKFTLLTVLAAAVAVPVTAEVYLKEQFNDEAWTSRWTESKDWKPESDMGTWKHTAGEWYSDEADKGIQTSVDARFFGISAPLDKPYTSSKDKDLVIQYSVKHEQDLDCGGAYIKLLPGGKSFQPAAFGGESPYAVMFGPDICGSSNKKTHVILHSNQKDENLLINKQVMCESDSVTHLYTLVVRPDNTFEVFVDNKSVRSGNLADEFDFLEPKEIKDPDAQKPEDWVDKAKIADPEDKKPEGYDDIPQELPDPDAVKPDDWDDEDDGEWEAPMIDNPEYKGPWKPKMIENPDYKGPWVHPMVPNPDYKDDDEMFMVCKDTCTHVGFELWQVKTGTLFDDIIVTDSLEEAHAFAQETFFKKKDGEKEMYDKIQAERQPEMPDMVSGETLSY

SEQ ID NO: 246 - protein, 17 aa, Artificial sequence
  motif 3
  UNSURE (8)..(8): Unknown amino acid
PKKIKDPXAKKPEDWDD

SEQ ID NO: 247 - protein, 14 aa, Artificial sequence
  motif 4
  UNSURE (5)..(5): Unknown amino acid
GPWKXKKIKNPNYK

SEQ ID NO: 248 - protein, 6 aa, Artificial sequence
  motif 5
  VARIANT (2)..(2): / replace = "Leu"
EVWQVK

SEQ ID NO: 249 - protein, 50 aa, Artificial sequence
  motif 6
  VARIANT (4)..(4): / replace = "Leu"
  VARIANT (21)..(21): / replace = "Val"
  VARIANT (36)..(36): / replace = "Glu"
TLVFQFSVKHEQKLDCGGGYMKLLSGDVDQKKFGGDTPYSIMFGPDICGY

SEQ ID NO: 250 - protein, 50 aa, Artificial sequence
  motif 7
  UNSURE (5)..(5): / replace = "Phe"
  UNSURE (11)..(11): / replace = "Leu"
  UNSURE (21)..(21): / replace = "Leu"
  UNSURE (37)..(37): / replace = "Glu"
  UNSURE (46)..(46): / replace = "Val"
TPYSLMFGPDICGTQTKKLHVILSYQGQNYPIKKDLQCETDKLTHFYTFI

SEQ ID NO: 251 - protein, 50 aa, Artificial sequence
  motif 8
  VARIANT (2)..(2): / replace = "Tyr"
  VARIANT (3)..(3): / replace = "Pro"
  VARIANT (7)..(7): / replace = "Glu"
  VARIANT (8)..(8): / replace = "Leu"
  VARIANT (14)..(14): / replace = "Lys"
  VARIANT (18)..(18): / replace = "Phe"
  VARIANT (23)..(23): / replace = "Ile"
  VARIANT (28)..(28): / replace = "Ser"
  VARIANT (36)..(36): / replace = "Arg"
  VARIANT (38)..(38): / replace = "Arg"
  VARIANT (39)..(39): / replace = "Glu"
  VARIANT (40)..(40): / replace = "Ser"
  VARIANT (43)..(43): / replace = "Met"
  VARIANT (45)..(45): / replace = "Ser"
  VARIANT (49)..(49): / replace = "Leu"
NHLIKKDVPCETDQLTHVYTFILRPDATYSILIDNVEKQTGSLYTDWDIL

SEQ ID NO: 252 - protein, 29 aa, Artificial sequence
  motif 9
  VARIANT (22)..(22): / replace = "Gln
  VARIANT (22)..(22): / replace = "Gln"
  VARIANT (26)..(26): / replace = "Leu"
  VARIANT (28)..(28): / replace = "Val"
QKKFGGDTPYSIMFGPDICGYSTKKVHAI

SEQ ID NO: 253 - DNA, 56 bp, Artificial sequence
  primer: prm10342
ggggacaagtttgtacaaaaaagcaggcttaaacaatggctactcgacgaatgaaa

SEQ ID NO: 254 - DNA, 50 bp, Artificial sequence
  primer: prm10343
ggggaccactttgtacaagaaagctgggttgaatcaaaatgcttggctct

SEQ ID NO: 255 - DNA, 56 bp, Artificial sequence
  primer: prm12468
ggggacaagtttgtacaaaaaagcaggcttaaacaatgggaaaccctaaaactctc

SEQ ID NO: 256 - DNA, 50 bp, Artificial sequence
  primer: prm12469
ggggaccactttgtacaagaaagctgggtaagagtgcttcctcatcacag

SEQ ID NO: 257 - DNA, 2194 bp, Oryza sativa; identical to SEQ ID NO: 103

SEQ ID NO: 258 - DNA, 1266 bp, Saccharum officinarum
atgccactgcgccgcctcgcgcctctcctagtgagcccgcgccgccgcttgcgctcctccctaaaccctagcctcgtcgccatgtcgccggccgccgctcacctggccacggccgccgatcacgacgaggacctctgcgcgagcgcggcggggtcagaagcggaggacctcgcgccgtccccgccgctcccgccgccgccggtgtccgcggatgagcgggtggagcgcgcgtgggcgcactggaggcggctggggtccccgcggctgctggtgacgccgatggtggacaactccgagctccccttccgcatgctgtgccgccgctacggcgccgacgcggcgtacacgcccatgctccactcccgcatcttctccgagaacgagaagtacaggtccatggagttcaccacgtgcaaggaggaccggccactttttgttcagttttgtgccaatgatcctgacattttgttacaagctgcaaagatggtggaaccatattgcgactatgttgatatcaattttggttgcccgcagcgtattgcaagacggggtaactatggagcatttctcatggacaaccttcccctcgtaaaatcccttgtgcagaatctagcagctaatcttcatgttccagtctcagttaagattcgcgtatttccacgactggaagacacattagcctatgcgaagatgcttgaggaagctggtgcttctcttgtggctgtccatggtcggacaagagatgaaaaggatgggaagaaatttcgagctgactgggatgccatcaaggctgtgaaggatgcacttagagtacccgttcttgcaaatggaaacattcgccatatggaggatgtgaagaactgcctggaacatactggtgctgatggtgtgctttcagctgaaactcttctagaaaatccagcactttttgctggtttcaggacaaaggaatggaaagaagatggtgatgagaatggagatagtggcttggaccaggctgatctagtgattgaatatttgaagctgtgtgagcagtaccctgtgccatggagaatggttagatcccatgtccacaagatgttgggggactggtttagggtgcatccagaagtgagggaggaactcaataagcagaacaaactcaccttcgaatggttgcatgacatggtattgaggctgaaggagctcggtggaagagtaccactttacagaaaggagagtgcactagggacaacattagatgggctagcctctagcaatgcctga

SEQ ID NO: 259 - protein, 421 aa, Saccharum officinarum
MPLRRLAPLLVSPRRRLRSSLNPSLVAMSPAAAHLATAADHDEDLCASAAGSEAEDLAPSPPLPPPPVSADERVERAWAHWRRLGSPRLLVTPMVDNSELPFRMLCRRYGADAAYTPMLHSRIFSENEKYRSMEFTTCKEDRPLFVQFCANDPDILLQAAKMVEPYCDYVDINFGCPQRIARRGNYGAFLMDNLPLVKSLVQNLAANLHVPVSVKIRVFPRLEDTLAYAKMLEEAGASLVAVHGRTRDEKDGKKFRADWDAIKAVKDALRVPVLANGNIRHMEDVKNCLEHTGADGVLSAETLLENPALFAGFRTKEWKEDGDENGDSGLDQADLVIEYLKLCEQYPVPWRMVRSHVHKMLGDWFRVHPEVREELNKQNKLTFEWLHDMVLRLKELGGRVPLYRKESALGTTLDGLASSNA

SEQ ID NO: 260 - DNA, 1272 bp, Arabidopsis thaliana
atgaaactaaatctctcgaatctcagatttctacgtacccgaaaatcgttaatctcccagacgcgagcaatgactcaaaatccggatccaaaacctgatccatcgcaggttctagacgatatcctctgttcggagcagcgtgatgggcagattgaggaaacagtcgacacagcgccggcgagcttgggctctccaagtcgggtcttaagcattgatactagagtagagagagcttgggcacactggaaaaaactgggtagacccaagtatatcgttgctccaatggttgataactctgagcttccgtttagattgctctgccagaaatacggagctcaggctgcttatactccgatgttgcattctaggatcttcaccgagactgagaagtatagaaatcaggagttcaccacctgtaaggaggacaggccattgtttgtgcagttctgtgctaatgatcctgatacgttattggaagctgcaaagagagtcgaaccttactgcgactatgttgatatcaatttagggtgtcctcagcgtatagcgaggcgaggaaattatggtgcattcttgatggataatcttcctttggtgaaatcacttgttgaaaagttagctcagaacctcaatgttcctgtctcctgtaaaatccggatcttcccgaacctggaagatacactcaagtacgccaagatgctagaagatgctggttgctcgctcctagctgttcacgggcgaacaagagatgagaaagacgggaagaaatttagagctgattggagcgcaatcaaggaagtgaaaaacgctatgagaatccctgtcttagcgaatgggaatgtaagatgcatcgaagatgtcgataactgcatcaaagagacgggtgttgaaggtgttctctctgcggagacgcttcttgaaaacccggcggcctttgctgggtttagaacagctgaatgggcaaaagataacgaagaagagggattcgtcgatggagggttagaccagggagatttagttgttgagtatttaaagctgtgtgagaagcatccggttccatggaggatgattcgatctcacgttcataagatgttgggagaatggtttagaattcatccacaagttagagagcaacttaatgctcaaaacatattgacgtttgagtttctatacggacttgtggatcagctaagagagcttggaggaagagttccactctacaagaaaaagaagatagatactctgactccacaagactctccacaaagggtttag

SEQ ID NO: 261 - protein, 423 aa, Arabidopsis thaliana
MKLNLSNLRFLRTRKSLISQTRAMTQNPDPKPDPSQVLDDILCSEQRDGQIEETVDTAPASLGSPSRVLSIDTRVERAWAHWKKLGRPKYIVAPMVDNSELPFRLLCQKYGAQAAYTPMLHSRIFTETEKYRNQEFTTCKEDRPLFVQFCANDPDTLLEAAKRVEPYCDYVDINLGCPQRIARRGNYGAFLMDNLPLVKSLVEKLAQNLNVPVSCKIRIFPNLEDTLKYAKMLEDAGCSLLAVHGRTRDEKDGKKFRADWSAIKEVKNAMRIPVLANGNVRCIEDVDNCIKETGVEGVLSAETLLENPAAFAGFRTAEWAKDNEEEGFVDGGLDQGDLVVEYLKLCEKHPVPWRMIRSHVHKMLGEWFRIHPQVREQLNAQNILTFEFLYGLVDQLRELGGRVPLYKKKKIDTLTPQDSPQRV

SEQ ID NO: 262 - DNA, 1269 bp, Brassica napus
atgaaaccctcgtctctttctcttctcaaatttctccggacccgagactctcccctcttacgaatccgaacaatgacaattacatcgaatccaccgcaagtgcgcgacgatctcctctgctcggaccagcagcagcagcagagtgatttgcagattgagaagccgccggaagcagcaccagcaagcttgggcgctccaggtcgagtattgagcattgatacaagggtggagcaggcctgggcgcactggaagaagctgggtagaccgaagtatatagtagctccaatggtggataactcagagcttccgtttagattgctctgtcaaaaatacggagctcaggctgcttacacaccgatgctgcactctaggatcttcaccgagactgataatcgaaacaaggaattcaccacttgtgaggaggacaggccgttgtttgtgcagttctgtgctaatgatcctgatactctcttggaagctgccaagaaagtcgcaccttactgcgattatgttgatatcaacttagggtgtcctcaacgtatagcgaggcgagggaactatggtgcattcttgatggataatcttcctttggtgaaatcacttgttgaaaagttagctcagaacctcactgttcctgtctcctgcaagatccggattttccctaaccttcaagatacgctcaactacgccaagatgcttgaagacgctggttgctcgctgctagcggttcacggccggaccagagatgagaaagacggtaaaaagtttagagccgattggggggccatcaaggaggtgagaaacgctctgagaatccctgttttagccaatgggaatgtgagatgcattgaagatgtggaggactgcatcaaagagacgggcgttgaaggtgttctttccgctgagacgcttcttgaaaacccggcggtctttgccgggtttagaacagctgaatgggctaaaggtagtgaagaagaagagggatacgtcgatggagggttagatcagggagatttagttgttgagtatttgaagttatgtgagaagcatccggttccatggaggatgattcggtctcacgtgcataagatgttgggagattggtttagggttcatccacaggttagggagcagcttaatgctcagaacatattgacgtttgagtttctgtatggtcttgtggaccagttaaaagagcttggaggacgagttcctctctacaagaaaaggaagatagatactctacaagagtctccacaaagggtttag

SEQ ID NO: 263 - protein, 422 aa, Brassica napus
MKPSSLSLLKFLRTRDSPLLRIRTMTITSNPPQVRDDLLCSDQQQQQSDLQIEKPPEAAPASLGAPGRVLSIDTRVEQAWAHWKKLGRPKYIVAPMVDNSELPFRLLCQKYGAQAAYTPMLHSRIFTETDNRNKEFTTCEEDRPLFVQFCANDPDTLLEAAKKVAPYCDYVDINLGCPQRIARRGNYGAFLMDNLPLVKSLVEKLAQNLTVPVSCKIRIFPNLQDTLNYAKMLEDAGCSLLAVHGRTRDEKDGKKFRADWGAIKEVRNALRIPVLANGNVRCIEDVEDCIKETGVEGVLSAETLLENPAVFAGFRTAEWAKGSEEEEGYVDGGLDQGDLVVEYLKLCEKHPVPWRMIRSHVHKMLGDWFRVHPQVREQLNAQNILTFEFLYGLVDQLKELGGRVPLYKKRKIDTLQESPQRV

SEQ ID NO: 264 - DNA, 1155 bp, Brassica napus
atgacccaaaacccggatccaaaccctgacccgtcacaagtactcgacgatctcctctcctcggagcagcagccggagagcttgagctctccaggtagggtcttgagcatcgatactagggtggagcaagcatgggcacactggaagaaactaggaagacccaagtacatcgttgctccgatggtggataactcggagcttccgttccgattgctctgccagaaatacggagctcaagctgcttacacgccgatgcttcattccagggtcttcaccgagactgagaagtatcgtaaccaagagttcaccacttgcaaggaggacaggccgttgtttgtgcagttctgtgctaatgatcctgatacgctcttggaagctgcaaagagagtccaaccttactgcgattatgttgatatcaacttagggtgtcctcaacgtattgcgaagcgaggaaactatggtgcattccttatggataaccttcctttggtgaagtcactcgttgagaagttagctcagaacctcactgtacctgtctcctgcaagatccgcattttccctaaccttcaagatacactcaattacgccaagatgctagaagaagccggttgctcgctgctagcggttcatggtcggacaagaaatgagaaagacgggaagaagtttagagctgattggggagccatcaaggaggtgagggaagctctgaggatccctgttttagccaatgggaacgtgagatgcgttgaagatgtggatgactgcatcagagagacgggtgttgaaggtgttctttccgctgagacgcttcttgagaacccggcggcctttgctgggtttagaacagctgcatgggctaaagaagagggatacgtggatggaggattagatcagggagatttagttgttgagtatttgaagttatgtgagaagcatccggttccgtggaggatgattcggtctcacgtgcataagatgctgggagactggtttagggtgcatccacaggttagggaggagtttaatgctcagaacatattgacgtttgagtttctatacggtcttgtggatcagcttaaagagcttggtggacgagttccactctacaagaaaaggaagatagatactccacaagagtctccacaaagggtttag

SEQ ID NO: 265 - protein, 384 aa, Brassica napus
MTQNPDPNPDPSQVLDDLLSSEQQPESLSSPGRVLSIDTRVEQAWAHWKKLGRPKYIVAPMVDNSELPFRLLCQKYGAQAAYTPMLHSRVFTETEKYRNQEFTTCKEDRPLFVQFCANDPDTLLEAAKRVQPYCDYVDINLGCPQRIAKRGNYGAFLMDNLPLVKSLVEKLAQNLTVPVSCKIRIFPNLQDTLNYAKMLEEAGCSLLAVHGRTRNEKDGKKFRADWGAIKEVREALRIPVLANGNVRCVEDVDDCIRETGVEGVLSAETLLENPAAFAGFRTAAWAKEEGYVDGGLDQGDLVVEYLKLCEKHPVPWRMIRSHVHKMLGDWFRVHPQVREEFNAQNILTFEFLYGLVDQLKELGGRVPLYKKRKIDTPQESPQRV

SEQ ID NO: 266 - DNA, 1185 bp, Chlorella vulgaris
atggctgcccaggaaccagacgcagcaacgcacggtcagagaggttgggaaatgttccggagctggggatctcccagatattttgttgcaccgatggttgatcagtcggagctggccttccgcatgctctgcagaaggcacggcgccactgcagcgtacactcctatgctacatagtcgtctcttcctgcaagaccccaactaccgagcagagcacttcagcacttgtgaaggagacaggcctctgatggtgcagttctgtgcaaatgatccggagacgctgcttgctgctgcacgcattgtggagccacatgctgatgccatagacctgaacctgggctgcccacagcgcatcgccaggaggggccgctatggggcgttcctgatggatgatctgccgctggtggagaggatagtgcggacgtgcgcggagggtctgagcgtgccggtgacggtgaagatccgagtgttccctgaccgccagaagacggtggaatatgcgcgcatgctggagcgggccggggccagcctcattgctgtgcacgggcggctgagggagcagaagaagtccaacggccctgatgccgactgggatgccattaaggcggtggtggaggcggtgggagtcccagtgctggccaatggaaacatccggacgctggcggacgtccacgcgtgcatggcatacacgggggcggtgggcgtgctgtcggccgagtcgctattggaggacccggcgctgttctcgccgcggcggctgcagcccgggggcgcctttgggggtgcccagggcgcgcatctgctgctggagtacctggacctggtggacgcccacccatgccccatgcgcatggtcaccgggcacgccttcaggatgctcggggcatggctgtcagagttcacggatctccgcgaccggctcaatcagcagcacaaggagtttggtgtggaggatatcagggagatagcgcaggacgtgatcagcagaatagaggggctggggcgcgactaccctgtgcccaagctgtctgagcgggctcttgcgcgcatggagagggaagctgccatggcagcggccatagcagagcagaacagagaggagtcttctttgcagcggattgcagcgaacagggcagaaagtctagggaatgtagaggctcgccgagtgcttcaggccgcggcatga

SEQ ID NO: 267 - protein, 394 aa, Chlorella vulgaris
MAAQEPDAATHGQRGWEMFRSWGSPRYFVAPMVDQSELAFRMLCRRHGATAAYTPMLHSRLFLQDPNYRAEHFSTCEGDRPLMVQFCANDPETLLAAARIVEPHADAIDLNLGCPQRIARRGRYGAFLMDDLPLVERIVRTCAEGLSVPVTVKIRVFPDRQKTVEYARMLERAGASLIAVHGRLREQKKSNGPDADWDAIKAVVEAVGVPVLANGNIRTLADVHACMAYTGAVGVLSAESLLEDPALFSPRRLQPGGAFGGAQGAHLLLEYLDLVDAHPCPMRMVTGHAFRMLGAWLSEFTDLRDRLNQQHKEFGVEDIREIAQDVISRIEGLGRDYPVPKLSERALARMEREAAMAAAIAEQNREESSLQRIAANRAESLGNVEARRVLQAAA

SEQ ID NO: 268 - DNA, 1221 bp, Emiliana huxleyi
atggttgcctccgcttgggacttttggcgcagcattggcagcccgcggcacgtctgcgcgccgatggtcgaccagtccgaggccgcgttccgcgtcctcacccgctcactcggcgtgcaactcgcctacacacccatgcttcacgcgcggctgatggtggaggcgccggcctaccgtgcgcacaccttcgatcccgagccggacggggtcgaccggccactggtggcacagctcgcagggcacgacgcgtcggttctcctcgccgcgggccggctcgtgcagtcgcacgtcgacgcggtggacatcaactttgggtgcccgcaggggatcgctcggaaggggcggtacggagccttcctcctcgacgagcccgagctggccgtctcgctcgtccgcgccctcgccgaggggctcgacgtgccggtcaccgcaaaggtgcggctgctcccgtcggtggacgcgagcgtcgctctctgccgccggatgcaagaggctggcgcctcggctctgtgcgtgcacgggcgcaccaaggagcaaaacaagcaccgctcgggcccggcggactgggccgcgattgctcgcatcgtcgaggcgctcgacatccccgtcatcgcaaacgggggcatcgcgaccgccgacgacgttgccgagtgcctcgcacgcacgggcgccgcggcggtgatgtcgtccgaggcgctgctcgagaaccccgccctcttctgcgccaacgtcgaccccgattcgggcgcctacctcgaccagcccgagcttgcgcgccgctacctccgcgtgtgccgccagctaccgccgccgaccctcggccacgtccggtcgcacctgttcaagctgctgcacgcccctctgcggcaccagccgctgcttcgtgaggacctcctcgaggcgacctcgctcgacgacgtcgagcccgtcgtcgagcggctggcggcgtgctcgcaccaccagccggccttccacacgccgcgctttgacgccgccgcgtcgtggtactggcgccaccgcaccgcggcggtctcggccgacggcgagctgggcgagacgcggggggcgggcggcgcgtcttcgcccgagtcgcgttcgcgggccgagctcgaggcggcggcgctggagcggcgcgatcggcggcggagggagaagaagcggcggcggcggcagcgaggggccgcgtcggtggcggcggcacccgcggttgccgttctctga

SEQ ID NO: 269 - protein, 406 aa, Emiliana huxleyi
MVASAWDFWRSIGSPRHVCAPMVDQSEAAFRVLTRSLGVQLAYTPMLHARLMVEAPAYRAHTFDPEPDGVDRPLVAQLAGHDASVLLAAGRLVQSHVDAVDINFGCPQGIARKGRYGAFLLDEPELAVSLVRALAEGLDVPVTAKVRLLPSVDASVALCRRMQEAGASALCVHGRTKEQNKHRSGPADWAAIARIVEALDIPVIANGGIATADDVAECLARTGAAAVMSSEALLENPALFCANVDPDSGAYLDQPELARRYLRVCRQLPPPTLGHVRSHLFKLLHAPLRHQPLLREDLLEATSLDDVEPVVERLAACSHHQPAFHTPRFDAAASWYWRHRTAAVSADGELGETRGAGGASSPESRSRAELEAAALERRDRRRREKKRRRRQRGAASVAAAPAVAVL

SEQ ID NO: 270 - DNA, 1209 bp, Glycine max
atgaaaccaaaacataaaccctactccttcctccctctcacccgacactttcgcgcgctacaatcttgtcccctcatggcccaaaccccaacttctctcgatgcagagcaccccgccgccgccgaccagcacgtgggctttccggcccggagcctgagcggagagtcttgggcggagcgggcgtgggcccactgggccaagctgggccggcccaggttcatagtggccccgatggtcgacaactcggagctgccgtttcgcatgctgtgccgcaagtacggtgcccagggcgcgtacacgccaatgctccattcccgcattttcaccgagaccgaaaagtacagaaacgaagaattcaccacttgcaaggaggatcgaccgttatttgttcagttctgtgccaacgatccagatgtgttgttggcagctgcacgcaaggtggagcctttttgcgattatgttgatattaatcttgggtgtcctcagcgcattgctaaacggggatactatggcgccttcttgatggataaccttcctctggtgaaatctctggtagaaaaattggctgttaaccttcaggttcctgtttcatgcaagattaggctctttccaaatttagaggacactttgaagtatgctaggatgcttgaggaggctggttgtatgcttttagctgttcatggcaggacaagagatgagaaggatgggaagaaatttcgagcagactggaacgctatcagggccgtgaagaatgcagtcagaatccctgtccttgcgaatgggaacataaggcatatggatgatgttagagactgcttggaagagactggtgttgaaggggtgctttctgccgagacactgcttgaaaatccagctctctttgatggatttcgaaccgccgaatgggtgtctgaaagtgaaggaaccaatctggatggaaaactggaccaggcagatctgctaatagaatatttgaagctttgtgaaaaatatcccgtgccgtggagaatgattcgttctcatgttcataaattgttgggagactggttcagccttcagcctcacatcagggaggaacttaacaaacaatctaaactgacttttgagtttctttatgacatggtggatcgacttaggagtacaggtactagaattccactttacaaaaatactgaagtggaacatacagcaggcagttacccagattaa

SEQ ID NO: 271 - protein, 402 aa, Glycine max
MKPKHKPYSFLPLTRHFRALQSCPLMAQTPTSLDAEHPAAADQHVGFPARSLSGESWAERAWAHWAKLGRPRFIVAPMVDNSELPFRMLCRKYGAQGAYTPMLHSRIFTETEKYRNEEFTTCKEDRPLFVQFCANDPDVLLAAARKVEPFCDYVDINLGCPQRIAKRGYYGAFLMDNLPLVKSLVEKLAVNLQVPVSCKIRLFPNLEDTLKYARMLEEAGCMLLAVHGRTRDEKDGKKFRADWNAIRAVKNAVRIPVLANGNIRHMDDVRDCLEETGVEGVLSAETLLENPALFDGFRTAEWVSESEGTNLDGKLDQADLLIEYLKLCEKYPVPWRMIRSHVHKLLGDWFSLQPHIREELNKQSKLTFEFLYDMVDRLRSTGTRIPLYKNTEVEHTAGSYPD

SEQ ID NO: 272 - DNA, 1209 bp, Glycine max
atgaaaccaaaacctaaaccctactccttcctccctctcaaccgatttcttcgcgcgctacaatctcgtcccctcatggcccaaaccccaacatctctcgatgcagagcacccctccgacaacgaccagcacatgggctttcgggcgcggagcctgagcggagagtctcgggcggagcaagcgtgggcccattggaccaagctgggccggcccaggttcatagtggccccgatggtcgacaactcggagctgcctttccggatgctgtgccgcaagtacggtgcccagggcgcgtacacgcccatgctccattcccgcattttcaccgagaccgaaaagtataggaacgaagagttcaccacttgcaaggaggatcgaccgttgtttgttcaattctgtgccaacgatccggatgtgttgttggaagctgcacgcaaggtggaacgtttttgcgattatgttgatattaatcttgggtgtcctcagcgcattgctaaacggggatactatggtgccttcttgatggataaccttcctcttgtgaaatctctggtggaaaaattggctgttaaccttcaggttcctgtttcatgcaagattaggctctttccaaatttagaggacactttgaagtatgctaggatgcttgaggaggctggttgtatgcttttagctgttcatggcaggacaagagatgagaaggatgggaagaaatttcgagcagactggaaagctatcagggctgtgaagaatgcagtcagaatccctgtccttgcgaatgggaacataaggcatattgatgatgttagagactgcttagaagagactggggtcgaaggggttctttccgctgagaccctgctagaaaatccagctctctttgctggatttcgaactgctgagtgggtgtctgaaagtgaaggtaccaatgtggatggaaagctggaccaggcagatctgctaatagagtatttgaagctttgtgaaaaataccctgttccgtggagaatgattcgttctcatgttcataaattgttgggagactggttcagccttcagcctcacatcagggaggaacttaacaaacaatctaaattgacttttgaatttctttatgacatggtggatcgacttagggctacaggtataagaattccactttacaaagatacccaagtggaacttacagcaggcagttacccagattaa

SEQ ID NO: 273 - protein, 402 aa, Glycine max
MKPKPKPYSFLPLNRFLRALQSRPLMAQTPTSLDAEHPSDNDQHMGFRARSLSGESRAEQAWAHWTKLGRPRFIVAPMVDNSELPFRMLCRKYGAQGAYTPMLHSRIFTETEKYRNEEFTTCKEDRPLFVQFCANDPDVLLEAARKVERFCDYVDINLGCPQRIAKRGYYGAFLMDNLPLVKSLVEKLAVNLQVPVSCKIRLFPNLEDTLKYARMLEEAGCMLLAVHGRTRDEKDGKKFRADWKAIRAVKNAVRIPVLANGNIRHIDDVRDCLEETGVEGVLSAETLLENPALFAGFRTAEWVSESEGTNVDGKLDQADLLIEYLKLCEKYPVPWRMIRSHVHKLLGDWFSLQPHIREELNKQSKLTFEFLYDMVDRLRATGIRIPLYKDTQVELTAGSYPD

SEQ ID NO: 274 - DNA, 1266 bp, Oyza sativa
atgcgattcgctcccatcctccggaacccgcgccgccgccgcctcctccgctccgtaaaccctagcctcgccgccatgtcgccgccggccgccgcccacctcgccaccgcctccgatcccgacgaggacctctgcttcaccaccgaatcggtcgcgcccgcggaggagaccgccccgcccttgcccgcccctccgccgccggtgtccgcggaggagagggtggagcgcgcgtgggcgcactggaggcggctgggctccccgaagatggtggtggcgcccatggtggacaactcggagctccccttccgcatgctgtgccgccgctacggggcgaccggggcatacacgcccatgctccactcccgcatcttctccgagaacgagaagcacagggccatggagttcaccacatgcaaggaggaccgtccactttttgttcagttttgtgcaaatgatcctgacattttgttacaagcagcaaagattgtggaaccgtactgcgactatgtcgatatcaattttggatgcccacagcgcattgctagaagggggtactatggtgcgtttctcatgaacaaccttcctctcgtaaaatcccttgtacagaatctatcagcaaacctccatgttccagtatcatgcaagattcgcatattcccgcgactggaggacacactggcctacgcaaagatgcttgaagaagctggtgcttctctggtagctgtgcatgggcggactagagatgagaaggatgggaagaaatttcgagctgactgggatgccattaaagctgtcaaagatgctcttaggatacctgtacttgcaaatggaaacattcgccatttggatgatgtgaaggattgccttgaacatactggtgctgatggtgtgctttcagctgaaactcttctagaaaatccagcattgtttgctggtttccggacaaaggaatggaaagaaaatggtgatgaagatgaagctagtggcttagaccaggctgatctagtcattgagtatttgaaactgtgcgagcagtaccctgttccatggagaatggttcgatcccatgttcacaagatgctaggggactggtttagggtgcatcctcaagtgagggaggaactcaatgctcagtccaagctcactttcgagtggttgcatgatatggtaaagaggctgaaggatcttggtggaggaataccgctttacagaaacaataatgctttacagactacatcaaatgggctagctgcaagcaacgcctga

SEQ ID NO: 275 - protein, 421 aa, Oyza sativa
MRFAPILRNPRRRRLLRSVNPSLAAMSPPAAAHLATASDPDEDLCFTTESVAPAEETAPPLPAPPPPVSAEERVERAWAHWRRLGSPKMVVAPMVDNSELPFRMLCRRYGATGAYTPMLHSRIFSENEKHRAMEFTTCKEDRPLFVQFCANDPDILLQAAKIVEPYCDYVDINFGCPQRIARRGYYGAFLMNNLPLVKSLVQNLSANLHVPVSCKIRIFPRLEDTLAYAKMLEEAGASLVAVHGRTRDEKDGKKFRADWDAIKAVKDALRIPVLANGNIRHLDDVKDCLEHTGADGVLSAETLLENPALFAGFRTKEWKENGDEDEASGLDQADLVIEYLKLCEQYPVPWRMVRSHVHKMLGDWFRVHPQVREELNAQSKLTFEWLHDMVKRLKDLGGGIPLYRNNNALQTTSNGLAASNA

SEQ ID NO: 276 - DNA, 1206 bp, Physcomitrella patens
atgagggaactggtggaaggtgccgacattgaggatgtgaattcggcaaagaggttgaaggtggaggcagcttttgctgttttgcctcatgctgcaagggcgtgggatcattggaacaagcttggcgcgcccaagttgatggtggctcctatggtggatcagagtgagcttccgttcagaatgttgtgtaggaagtatggagccacggctgcctattcgcccatgttacattctcgattattcgcccaagatgctaaataccggcttaaagagttctctacatgccctgaggatcgccccctttttattcaattttgtgccaacaatccggacacgttgttagaagcagccaagttggtgcaagatgattgcgattatgttgacatcaattttgggtgccctcaacgcatagccaagagaggcaattacggagcgttcctcatggatgacctacctttagtccgatctctggttgagaaactctcatccggcttgacaactcctgtttcctgcaaaattcgaatgttcccaaagttggaagacacgcttgcttacgctcgcatgatagaggaggcaggttgctccttactggccgttcatgggcgcacgcgcgatcaaaaagacggtaaaagtattagagctgactggggagttatcaaggctgtcaaatcagctcttcgcattccagttgtagcaaatgggaatatccggtggcttgaggacgtagacgaatgcataagggcgacgggcgtggacggtgtaatgtcagcagaatctctactcgagaaccctgctctttttgccggttacaggatgaaacctctcgactcttccgctgcggaaccagacgatcatgataaaaagtactcgctcaatgaaccaacactagtcctggaatatttagacttttgtgacaagtacccagttccagctcggatgatccgtgctcatgtgcaccgaatgttaggcccatggtttagacaatatccacacctgcgcgaggagctgaacaagcaatttagtattactacagagtggctgaagggactagttcacaggctcctcgctgaacacgaagcgtcggagatattgaggcagactggcgctttagatcaggttcgtgagaatggagttgctcagcctataataatcgatgcgttgtctgattcttctgccttgcaaactgccaatgcagttgttagctga

SEQ ID NO: 277 - protein, 401 aa, Physcomitrella patens
MRELVEGADIEDVNSAKRLKVEAAFAVLPHAARAWDHWNKLGAPKLMVAPMVDQSELPFRMLCRKYGATAAYSPMLHSRLFAQDAKYRLKEFSTCPEDRPLFIQFCANNPDTLLEAAKLVQDDCDYVDINFGCPQRIAKRGNYGAFLMDDLPLVRSLVEKLSSGLTTPVSCKIRMFPKLEDTLAYARMIEEAGCSLLAVHGRTRDQKDGKSIRADWGVIKAVKSALRIPVVANGNIRWLEDVDECIRATGVDGVMSAESLLENPALFAGYRMKPLDSSAAEPDDHDKKYSLNEPTLVLEYLDFCDKYPVPARMIRAHVHRMLGPWFRQYPHLREELNKQFSITTEWLKGLVHRLLAEHEASEILRQTGALDQVRENGVAQPIIIDALSDSSALQTANAVVS

SEQ ID NO: 278 - DNA, 1434 bp, Pinus taeda
atgaagacaaggccttctatcgcacgtctttcatcaatttcaagcatagataatcgaaattctcatggcctgacatttcctcttcttccttggacattaaaacgatttcacttctcctcttcctctgttgttccaatgacaaaagaggcctcggaggacgcagacaacgtcctgtgttcgagagtcgctgacttcactctttccgaatcaccacatagttcttcagaggatgcagctgaagatacctttgaagccatagattgttcagtcctctccactcttgtggactctgaacactcctcacctgattcaagcgatggatgtatggcagatgggtctctgatagaaaaggcatggaggcactggaggaagctgggggaacccaaattgatagtggcacccatggttgatcaatccgaacttccattcagaatgctctgcagaaagtacggggccactgctgcttacacacccatgttgcatgctcgcctttttgcagaaaatcccaaatatcataagcttgaattcaccacatgtaaggaagatcgtcctttgtttgtgcaattttgtgcaaacgaccctgaaaaactattggctgcagctcagcttgttcaaaattgttgtgattatgttgatatcaatttggggtgcccacaacgcattgccaaacgaggtaattatggagcatttttgatggacaacttgccacttgtggaatccttagttaaaaatctggcttctaacttatctgtgcctgtatcatgtaagattcggatgtttccttcccttgaggacactatagcatatgccaaaatgcttgaggctgcaggatgctcacttcttgctgttcatggacgcaccagggatcagaaagatgggaaaagtgttagagcagattgggctgtaattaatgctgtcaagaaggctgttagaattcctgttttggcaaatggaaatataagatatttagaagatgtctatgattgtttaagagagactggtgcagatggagttttgtcagctgaatccatactggaaaatcctgcactttttgcagggtatcgattaatggcagactgggaagataattcaagctcccaggcagaagaggtgctagaaaaatatgagagagtgaagcatactgaacatgaacttaaacatccattcaatcaggcaactctggtgttggaatactttgatctttgtgagaaatatccagttccatggcgaatggttcgagcccacgtgcaccgaatgttaggtgactggttcaggatttatccagatctacgtcaggaactcaacaaacagtctaagttgacattcgagtggcttcgagatatggtgcatcagctgatggaacgtgataccaaactcgtccttcgtccatcaacaccatgtgaaaagctgatatacaaagcatcttcctgttga

SEQ ID NO: 279 - protein, 477 aa, Pinus taeda
MKTRPSIARLSSISSIDNRNSHGLTFPLLPWTLKRFHFSSSSVVPMTKEASEDADNVLCSRVADFTLSESPHSSSEDAAEDTFEAIDCSVLSTLVDSEHSSPDSSDGCMADGSLIEKAWRHWRKLGEPKLIVAPMVDQSELPFRMLCRKYGATAAYTPMLHARLFAENPKYHKLEFTTCKEDRPLFVQFCANDPEKLLAAAQLVQNCCDYVDINLGCPQRIAKRGNYGAFLMDNLPLVESLVKNLASNLSVPVSCKIRMFPSLEDTIAYAKMLEAAGCSLLAVHGRTRDQKDGKSVRADWAVINAVKKAVRIPVLANGNIRYLEDVYDCLRETGADGVLSAESILENPALFAGYRLMADWEDNSSSQAEEVLEKYERVKHTEHELKHPFNQATLVLEYFDLCEKYPVPWRMVRAHVHRMLGDWFRIYPDLRQELNKQSKLTFEWLRDMVHQLMERDTKLVLRPSTPCEKLIYKASSC

SEQ ID NO: 280 - DNA, 1281 bp, Ricinus communis
atgagatctctcttttgtttgcacaaacctctcctctctacatccttaaaacctctcatggcctcttctctaactcgtaccgtggctatagaccaagacaacgacgacgacgaagttctctgctctagtgcacatcaagaacatacctcgttttctactctgccggacacggtgtcgtcttcgtgtttgggctcggccacgccgagctgttatttaaatggagagtccagggtggaccgggcatgggctcactggaataagattggtaaaccgaagttattagtagctccaatggtagataattctgaacttccttttcgaatgctttgcagaaagtatggcgctgatgctgcttatactcctatgttacattctcgaatttttactgagaatgaaaagtaccgtacccaagaatttaccacttgtaacgaggatcgcccattatttgtccaattttgtgctaatgacccagacattctattagaagctgcaaggaaggtggagccttattgtgattacgttgatatcaatcttgggtgtcctcagcggattgccaggcgggggaattacggggctttcttaatggataatcttccacttgttaaatccttagttgaaaagttggctctaaaccttaatgtccctgtgtcttgcaaaatccgactattcccgaaattagatgatactatcagttatgctagaatgctggaggaagctggttgttctcttttagctgttcatgggcgaactagagatgagaaagacggaaagaaattccgagctgactggaaggcgattaaggctgtaagaaatgctgtcaaaattccacttcttgctaatggcaatgttcggcacatggatgatgttcggaactgtttggaggagacaggtgctgatggggtgctttcagctgagtctcttcttgagaatccagctctctttgctggatttcggacagctgaatgggttgttggagatgaagaaagcactagagatggaaaactggaccaggcagatctcttagtggagtatttgaagctttgtgaagagtaccctgtgccctggagaatgattcgtgctcatgtgcacaagatgttgggagattggttccggatacatcctcatgtaagagaggaactcaatgcacagtccaggctgacctttgaatttctgtataatgttgtggatcaacttagagcgctgggtgtgaggattccgctttatgtgaaagatctggatactagtgcaacaggagttgctgcaaatggtttgaccaattga

SEQ ID NO: 281 - protein, 426 aa, Ricinus communis
MRSLFCLHKPLLSTSLKPLMASSLTRTVAIDQDNDDDEVLCSSAHQEHTSFSTLPDTVSSSCLGSATPSCYLNGESRVDRAWAHWNKIGKPKLLVAPMVDNSELPFRMLCRKYGADAAYTPMLHSRIFTENEKYRTQEFTTCNEDRPLFVQFCANDPDILLEAARKVEPYCDYVDINLGCPQRIARRGNYGAFLMDNLPLVKSLVEKLALNLNVPVSCKIRLFPKLDDTISYARMLEEAGCSLLAVHGRTRDEKDGKKFRADWKAIKAVRNAVKIPLLANGNVRHMDDVRNCLEETGADGVLSAESLLENPALFAGFRTAEWVVGDEESTRDGKLDQADLLVEYLKLCEEYPVPWRMIRAHVHKMLGDWFRIHPHVREELNAQSRLTFEFLYNVVDQLRALGVRIPLYVKDLDTSATGVAANGLTN

SEQ ID NO: 282 - DNA, 1137 bp, Selaginella moellendorffii
atggcggtggcggccgcgcaggcgcccttgcagatcaatggattccactgcgccgccgcagagcctgatttggaggctgagctaccactcaactcgttctcactgtctcgtcacattgagagatcgtgggatcactggagacgcattggagctccgaagttcatggtggcgcccatggtggatcaatccgagctgcccttccggatgctgtgtagaaaatatggggccactggagcctacactccaatgctccacgctcgtctcttctcggaagatagaaaatatcgaaactacgagttcacgacttgtccggaagatcggccattgctgatacaattttgtgctaataacccggatacgttgctcgcagcagcaaaactcgtggaaccattttgcgactacattgacatcaacctggggtgtccgcaaaggatagccaagcgaggaaactatggagcgttcctcatggatgacttacctctagttcaggcactggtaacaaagctcgtctccaacttggacgttccagtttcgtgcaagattcggatgtttcccagcctcgacgacaccatctcatacgcaaagatgctggagagctcggggtgctcgctgctggcagttcacggccggacgagggagcaaaagtgttcgagaacagtgagagccgactgggaggtgatccgagcagtgaagcaggctttgcgaattcccgttttggcgaatggaaacattcgctggctggaagacgccgagagatgcatccaggaaacaggagtggacggtgttttgtctgcggaatcactgctcgagaatccagcgctctttgctggatacagaactttcaaacccagtgacagcgaggacgaagagcaggggtcgagtaaacttatgatcgatccggtgactttactcatggaatacttggatcagtgcgagaagtatccggctccggacaagtgtatccgtgctcatgttcacaggctgctgggtgaatggtttcgagttcatcctgatcttcgcgagaaactgaacagggaacacaaggtggatagtacctggctgagggatctgggaagggagatgttagaaaggatgagaccaaagcttggtgaagttgctgaggaagccagtgactaa

SEQ ID NO: 283 - protein, 378 aa, Selaginella moellendorffii
MAVAAAQAPLQINGFHCAAAEPDLEAELPLNSFSLSRHIERSWDHWRRIGAPKFMVAPMVDQSELPFRMLCRKYGATGAYTPMLHARLFSEDRKYRNYEFTTCPEDRPLLIQFCANNPDTLLAAAKLVEPFCDYIDINLGCPQRIAKRGNYGAFLMDDLPLVQALVTKLVSNLDVPVSCKIRMFPSLDDTISYAKMLESSGCSLLAVHGRTREQKCSRTVRADWEVIRAVKQALRIPVLANGNIRWLEDAERCIQETGVDGVLSAESLLENPALFAGYRTFKPSDSEDEEQGSSKLMIDPVTLLMEYLDQCEKYPAPDKCIRAHVHRLLGEWFRVHPDLREKLNREHKVDSTWLRDLGREMLERMRPKLGEVAEEASD

SEQ ID NO: 284 - DNA, 1287 bp, Solanum lycopersicum
atgagattccaactaatctccgtcagctccattttcatcctaaattctcgccaccacacataccttcatagaaacctttccatggctactgaaaccctaaattccgccattaacggcgaagtcgtcgacgacgatcttctttgctccgacgccaccaccacttcatctatcattgaacaagaaggagggaggcatccagtcggactgaattgtgcgaacggttacttaaagggggaagcacggatagagagagcttgggctcattggaagaagttaggagagccgaaacttattgttgctccaatggttgacaactcagagttgccttttcgtctgctgtgtcgaaagcatggtgcgcaagctgcttatacacctatgcttcactcccgtatcttcagtgaaaatgagaagtatcgttctcttgaatttactacctgcaaggaggaccatccactttttgttcaattctgtgcaaatgatccagacactttgctagaagcagctcgaagagtagagccatactgcgactatgtggacatcaacttggggtgtccccagcgtattgcaagacgagggaattatggagcattcctcatggataatcttcctcttgtgaagtctctggtagaaaagttggctaacaatcttgatgttcctgtgtcatgcaaaatacgagttttccctaatttgcaagatacacttagttatgcaaaaatgttggaggatgctggttgttctcttttagcagtgcacggccgaacaagggatgaaaaagacggaaagaaattcagagccaattgggaggccatcaaagctgttagagacgttgttaggattcctgtccttgctaatggtgatatacggcacatggatgatgtacataactgcttggaaaagactggtgccgatggggtactttcagcggaatctcttcttgaaaatccagctctatttgcaggatatcgaactgctcaatggggattgagcactgcaggaatcaaagaagatggtaagctagaccaagctcagttagtcgtagattatttgaagttgtgtgagagacatccagtgccatggagaatgatccgttctcatgtgcacaagatgctgggagagtggtttaggatcgagccaagcgttagagaggatttcaaccagcaatcccaactcaccttcgaattcctttatggcttggtaaatcgattaagggaacttggagtgagtgtaccactttatgtgaaggagactcaagaggaagctgcatctccaaatggagacggggcataa

SEQ ID NO: 285 - protein, 428 aa, Solanum lycopersicum
MRFQLISVSSIFILNSRHHTYLHRNLSMATETLNSAINGEVVDDDLLCSDATTTSSIIEQEGGRHPVGLNCANGYLKGEARIERAWAHWKKLGEPKLIVAPMVDNSELPFRLLCRKHGAQAAYTPMLHSRIFSENEKYRSLEFTTCKEDHPLFVQFCANDPDTLLEAARRVEPYCDYVDINLGCPQRIARRGNYGAFLMDNLPLVKSLVEKLANNLDVPVSCKIRVFPNLQDTLSYAKMLEDAGCSLLAVHGRTRDEKDGKKFRANWEAIKAVRDVVRIPVLANGDIRHMDDVHNCLEKTGADGVLSAESLLENPALFAGYRTAQWGLSTAGIKEDGKLDQAQLVVDYLKLCERHPVPWRMIRSHVHKMLGEWFRIEPSVREDFNQQSQLTFEFLYGLVNRLRELGVSVPLYVKETQEEAASPNGDGA

SEQ ID NO: 286 - DNA, 1266 bp, Sorghum bicolor
atgccactgcgccgcctcgcgcctctcctagcgagcccgcgccgccgcctgcgctcctcccaaaaccctagccccgccaccatgtccccggccgccgctcacctggccacggccgccgaccccgacgaggacctctgcgcgagcgccgcggggtcagaagcggaggacctcgcgctggctccgccgctcccgccgccgccggtgtccgcggaggagcgggtggagcgcgcatgggcgcactggagacggctggggtccccgcggctgctggtggcccctatggtggacaactccgagctccccttccgcatgctgtgccgccgctacggcgccgacgcggcgtacacgcccatgctccattcccgcatcttctccgagaacgagaagtacaggtccatggagttcaccacgtgcaaggaggatcgaccactttttgttcagttttgtgccaatgatcctgacattttgttacaagctgcaaagatggtggaaccacattgtgactatgttgatatcaattttggttgcccacagcgtattgcaagacggggtaactatggagcatttctcatggacaaccttccccttgtaaaatcccttgtgcagaatctagcagctaatcttcatgttccagtctcagttaagattcgcgtatttccacgactggaagacacattagcctacgcgaagatgcttgaggaagctggtgcttctcttgtggctgtccatggtcggacaagagatgaaaaagatgggaagaaatttcgagctgactgggatgccatcaaggctgtgaaggatgcacttagagtacctgttcttgcaaatggaaacatccgccacatggaggatgtgaagaattgcctggaacatactggtgctgatggtgtgctttcagctgaaactcttctagaaaatccagcactttttgctggtttcaggacaaaggaatggaaggaagatagtgatgagaacggagatagcggcttggaccaggctgatctagtgattgaatatttgaagctgtgtgagcagtaccctgtgccatggagaatggttagatcccatgtccacaagatgttaggggactggtttagggtgcatccagaagtgagagaggaactcaataagcagaacaaactcaccttcgaatggttgcatgacatggtaatgaggctgaaggagctcggtggaagagtaccactttacagaaaggagactgcactagagacaacgttagatgggctagcctctagcaatgcctga

SEQ ID NO: 287 - protein, 421 aa, Sorghum bicolor
MPLRRLAPLLASPRRRLRSSQNPSPATMSPAAAHLATAADPDEDLCASAAGSEAEDLALAPPLPPPPVSAEERVERAWAHWRRLGSPRLLVAPMVDNSELPFRMLCRRYGADAAYTPMLHSRIFSENEKYRSMEFTTCKEDRPLFVQFCANDPDILLQAAKMVEPHCDYVDINFGCPQRIARRGNYGAFLMDNLPLVKSLVQNLAANLHVPVSVKIRVFPRLEDTLAYAKMLEEAGASLVAVHGRTRDEKDGKKFRADWDAIKAVKDALRVPVLANGNIRHMEDVKNCLEHTGADGVLSAETLLENPALFAGFRTKEWKEDSDENGDSGLDQADLVIEYLKLCEQYPVPWRMVRSHVHKMLGDWFRVHPEVREELNKQNKLTFEWLHDMVMRLKELGGRVPLYRKETALETTLDGLASSNA

SEQ ID NO: 288 - DNA, 1242 bp, Vitis vinifera
atgaaactcaattcctggccgttttcccccttgttcacctctctcaagcatctctcacgttccatatataccatggcctcttctatatctgaaaccctaaccctaactctgcccgcgggttcgccacaggactcgaacttggatgatcacatctgctccgaacaacaagaacatcaagaatgccaatcttcttcggctgattggccgagtcgatgcctgaccggagagtcgcgtattgagcgagcatgggcgcattggaagaagcttggtcaacccaaattgattgttgctcccatggttgacaattcggagctcccttttcggatgctttgtcgcaagtacggcgcccaagctgcgtatacgccaatgctccactctcgcatcttctctgaaaacgaaaagtatcgatctcaggaattcaccacctgcaaggaggatcgcccactatttgtccaattctgtgctaatgatccggacactttactggaagcagctcagagagtggaaccttattgtgactatgttgacattaatttgggatgtcctcagcgtattgctcggcgagggaactatggagctttcctaatggataaccttcctcttgtcaaatccttggtggaaaagttggctctcaaccttcatgtccctgtgtcatgcaaaatccgagtgttcccaaatttacaggatacaatcaactatgctaggatgcttgaggatgctggttgctctcttttggctgtccatggccggacaagagatgagaaggatgggaagaaattccgggcagactggaatgctattaaggctgtgaaaaatgctgtcagcattccagtccttgctaatggggacataaggcacatggatgatgttcagagatgtttggaagagacgggtgctgatggggtgctttctgctgagtctctccttgagaatccagctctctttgctggattccagactgctgaatgggctctggaccaggcaaatttactggttgagtatttgaagctttgtgagaaataccctgtgccttggagaatgatccgttctcatgtgcacaagttgttgggagagtggttcaggattcaaccacaagtaagagatgatctaaattcacagtctaaactcacttttgaatttctttataatatggtggatcagctcagggagttgggtgtaaggattccgctgtatacaaaggatactcctgcaggaaggacttcaaatgggattgcaacttga

SEQ ID NO: 289 - protein, 413 aa, Vitis vinifera
MKLNSWPFSPLFTSLKHLSRSIYTMASSISETLTLTLPAGSPQDSNLDDHICSEQQEHQECQSSSADWPSRCLTGESRIERAWAHWKKLGQPKLIVAPMVDNSELPFRMLCRKYGAQAAYTPMLHSRIFSENEKYRSQEFTTCKEDRPLFVQFCANDPDTLLEAAQRVEPYCDYVDINLGCPQRIARRGNYGAFLMDNLPLVKSLVEKLALNLHVPVSCKIRVFPNLQDTINYARMLEDAGCSLLAVHGRTRDEKDGKKFRADWNAIKAVKNAVSIPVLANGDIRHMDDVQRCLEETGADGVLSAESLLENPALFAGFQTAEWALDQANLLVEYLKLCEKYPVPWRMIRSHVHKLLGEWFRIQPQVRDDLNSQSKLTFEFLYNMVDQLRELGVRIPLYTKDTPAGRTSNGIAT

SEQ ID NO: 290 - DNA, 1269 bp, Volvox carteri
atgactgtagcggttccgccgccaccggcggtgccggcgtcggcactgtatgagccgaggacgaccatggacgcagcaccgttgcaacgaccgcctcatgctgacatggcctgggagtggttccggagcattggctctccgaaattccacgtggccccgatggttgaccagtctgagctgcccttccggctgctgtgtcgccggcacggcgccacatgcgcatacacgcccatgctgcacgcaaggatcttcagtcaggaccgcaaatacagggaggagatgctcaccacgtgttccgaggaccggcccctgctggtgcagttctgtgcccacgagccgcagcacctgctggcagctgctcgcctcgtgcaggatagcggggtggcggatgccattgacatcaactttgggtgcccccagcgtatcgccaaacggggcggctacggagcgtttctaatggacgacctgccgcgagtggagtcactggtgcgggtgctggcccagaacctccgtatccccgttaccgccaagatccgcatcttccccgatctggcaaaaacagtcgcctatgcaaggatggtggaggcggcgggagcgtctctggtggccgtacacggtcgcctgagggagcagaaggataacagctccacacgagcggactgggacgcgatcagggcggtcaaggcggcgctcagcgtgccggtgctggcgaacggcaatatacggcacctgggtgacgtgggagcctgtctgtcgtacactggcgccgacggcgtgctgtcagcggagtcgttgttggcagacccggcgctgtttgatgtgccggcgagggcgtcggtggctgttggagatgtgagtggacggggtcggtggtattcggcaccccccctggagcgtctgtccctagctgcccagtacatggacctggtgcgcgcccacccggtgcccctgcgcatggttcgggggcatgtgcacaagatggtgggcgattggctggctgaacacacggacctgagggacaacatcaacagactgccacccactatccagctattctgccaggtgcgtgtgagggtttgtgggggggttaaagaggtgtgtgtatgtgtttatgtgtctcggtttgcgaatgaccctgtcctgtcccgtcatgcgtgtggtggtcacatacactgcgtcactcattgtcgccttgccaggtgtagtgtggcgccctgcccccttacatcttgctctttcttacttttgctgctgatagagcaatgctag

SEQ ID NO: 291 - protein, 422 aa, Volvox carteri
MTVAVPPPPAVPASALYEPRTTMDAAPLQRPPHADMAWEWFRSIGSPKFHVAPMVDQSELPFRLLCRRHGATCAYTPMLHARIFSQDRKYREEMLTTCSEDRPLLVQFCAHEPQHLLAAARLVQDSGVADAIDINFGCPQRIAKRGGYGAFLMDDLPRVESLVRVLAQNLRIPVTAKIRIFPDLAKTVAYARMVEAAGASLVAVHGRLREQKDNSSTRADWDAIRAVKAALSVPVLANGNIRHLGDVGACLSYTGADGVLSAESLLADPALFDVPARASVAVGDVSGRGRWYSAPPLERLSLAAQYMDLVRAHPVPLRMVRGHVHKMVGDWLAEHTDLRDNINRLPPTIQLFCQVRVRVCGGVKEVCVCVYVSRFANDPVLSRHACGGHIHCVTHCRLARCSVAPCPLTSCSFLLLLLIEQC

SEQ ID NO: 292 - DNA, 1263 bp, Zea mays
acaaacatctctaacaagattatataaattagattatataacctgaattatataatctatataaaataagctggattatataatgatgtgtgcaaccctgggagaagaagatctgggtgatgaacgttgtgaacgtggacgcgcccgacacactttcggtcatcttcgagcgcgggctgctgggcatctaccatgactggtgcgagtccttcagcgcctacccgagatcaaagaggtcagtggccagcaccaccagtctgtctgttttcttcacatctttctagcttgatgacgcacatggccgtcttcttcagatgcgcggttctgccatggtggtggaggtggacaggcacaggatcgtcaggccaggggtcagcatcgtcgtgcgcgacaaggccagcgccgtcggcgaggtggacaagctcctgagatcgctccacttggacgcgcggctgaaggacgacgaaggcgtgatgtacgcagagaagcccgattggcggccggagctcgaagaagagccgttgtaatggccaccatttcagagtggcgagcagtagggttcttttcttttcttgcgtccaccagcattgatagtactgtacatgattttgtcattgcttgcacgccagacggccagaggttctgtgaaatatatgcgcagctgaacatgcgcgcgaacatgttggtaatatagctttgtgaagcgtccaaagataagttcaatagcaaatccaaattatctgagaccatgtaatgatgtaaaaatgattttacatatcagctgttacaacaatgaggtgagccgttgcactgtagctgctcaactcaaaatatgctttactaatcgaggtttaattgtagtccaacaatctcttccagtctgtactatagcaggtcaaaattggtacaaaatgcttcagttttcatcaattgctcctctccaataatgataggctgcagatataagaacctgtcaggcattgctagaggctaatgtttgtcctagtgcagtctcctttctgtaaagtggcactcttccaccgaggtccttcagcctcattaccatgtcatgcaaccattcgaaggtgagcttgttctgcttattaagttcctccctcacctctggatgcaccctaaaccagtcgcccaacatcttgtggacatgggatctaaccattctccacggcacagggtactgctcacacagcttcagatattcaatcacaagatcagcctggtccaagccaccgtctccattctcgt

SEQ ID NO: 293 - protein, 420 aa, Zea mays
MQLRRLSPLLASPRRRLRLRSPTNPSSATMSPGAAHLATAADPDEDLCASAGASEAEVPAPAPHLPPLPVSAEERLERAWAHWRRLGSPRLLVAPMVDNSELPFRMLCRRYGADAAYTPMLHSRIFSENEKYRSMEFTTCKEDRPLFVQFCANDPDILLQAAKKVEPYCDYVDINFGCPQRIARRGNYGAFLMDNLPLVKSLVQNLAANLHVPVSVKIRVFPRLEDTLAYAKMLEEAGASLVAVHGRTRDEKDGKKFRADWDAIKAVKDALRVPVLANGNIRHMEDVKNCLEHTGADGVLSAETLLENPAVFAGFRTKEWKEDGDENGDGGLDQADLVIEYLKLCEQYPVPWRMVRSHVHKMLGDWFRVHPEVREELNKQNKLTFEWLHDMVMRLKDLGGRVPLYRKETALGQTLASSNA

SEQ ID NO: 294 - protein, 306 aa, Artificial sequence
  tRNA-dihydrouridine synthase domain comprised in SEQ ID NO: 2 (PFAM PF01207 Dus integrated into InterPro accession IPR001269 tRNA-dihydrouridine synthase)
LLVTPMVDNSELPFRMLCRRYGADAAYTPMLHSRIFSENEKYRSMEFTTCKEDRPLFVQFCANDPDILLQAAKMVEPYCDYVDINFGCPQRIARRGNYGAFLMDNLPLVKSLVQNLAANLHVPVSVKIRVFPRLEDTLAYAKMLEEAGASLVAVHGRTRDEKDGKKFRADWDAIKAVKDALRVPVLANGNIRHMEDVKNCLEHTGADGVLSAETLLENPALFAGFRTKEWKEDGDENGDSGLDQADLVIEYLKLCEQYPVPWRMVRSHVHKMLGDWFRVHPEVREELNKQNKLTFEWLHDMVLRLK

SEQ ID NO: 295 - DNA, 2194 bp, Oryza sativa; identical to SEQ ID NO: 103

SEQ ID NO: 296 - DNA, 48 bp, Artificial sequence
  primer: prm08359
ggggacaagtttgtacaaaaaagcaggcttaaacaatgccactgcgcc

SEQ ID NO: 297 - DNA, 44 bp, Artificial sequence
  primer: prm08360
ggggaccactttgtacaagaaagctgggtcctgtcaggcattgc

SEQ ID NO: 298 - DNA, 657 bp, Oryza sativa
atggcgaagtcgcggccgcccaagcggatcctcgagtcctacaccatcaagggctccgacaaagtcatcaagcctggggactgtgtgctaatgagggcatctgatacatcaaagccacccaatgtggcaagagttgaggctattgaggctgcagggtcacgaggcacaaatgtgagagtacgggtgcggtggtactatcggccagaggagtccatgggtggaaggcgtccatttcatggtgccaaagaggtgttcctctcggatcactatgacgtacagagtgctgacaccatagagggaaagtgcaacgttcacagcttccgtagctacacaaagcttgattctgtcaatgctgaggacttcttctgtcgctttgagtacaaatcagccacaggaagcttcgtgcccgaccgcattgctgtgttctgcaagtgtgagatgccatacaatcctgatgaccttatgatccaatgtgaggaatgctctgattggtttcacccttcttgcattggaatgactattaaagatgcaaaaaaactagagcattttttctgccagagctgtactgcggaaaatggaaagatggctgagaattctcatgaagctacagcgcaatccgaagaaaagcaggtggagtcaaaaagacggagaaggtga

SEQ ID NO: 299 - protein, 218 aa, Oryza sativa
MAKSRPPKRILESYTIKGSDKVIKPGDCVLMRASDTSKPPNVARVEAIEAAGSRGTNVRVRVRWYYRPEESMGGRRPFHGAKEVFLSDHYDVQSADTIEGKCNVHSFRSYTKLDSVNAEDFFCRFEYKSATGSFVPDRIAVFCKCEMPYNPDDLMIQCEECSDWFHPSCIGMTIKDAKKLEHFFCQSCTAENGKMAENSHEATAQSEEKQVESKRRRR

SEQ ID NO: 300 - DNA, 705 bp, Arabidopsis thaliana
atggcgaaaactcgacctggtgtcgcctccaaaattaagacgggaaggaaggagctggactcttataccatcaagggcaccaacaaagttgtgagagcgggagattgtgtgttgatgcgcccatcagatgctggtaaaccaccatatgtggcccgtgttgagaagattgaagctgatgcgaggaacaatgtgaaggtgcactgtcgatggtattaccgccctgaggagtcacttggtggtaggagacaatttcatggagccaaagagcttttcttgtctgaccattttgatgttcaaagtgcacacaccattgagggaaaatgcattgttcacaccttcaaaaactacacgaggcttgaaaacgttggggcagaggattattattgtagattcgagtacaaggctgctactggcgcatttacccctgatcgagttgctgtgtactgcaaatgtgaaatgccttacaatccagacgatctcatggtgcagtgtgaaggctgcaaagactggtatcatcctgcgtgtgttggcatgacgattgaagaagcaaagaagcttgatcactttgtatgtgctgaatgcagttctgatgacgatgtcaaaaaatcgcagaatgggtttacttcatctccagctgatgatgttaaggtccgtttgtctctctttagtcatctcctatatagatgttctatcacttatttataa

SEQ ID NO: 301 - protein, 234 aa, Arabidopsis thaliana
MAKTRPGVASKIKTGRKELDSYTIKGTNKVVRAGDCVLMRPSDAGKPPYVARVEKIEADARNNVKVHCRWYYRPEESLGGRRQFHGAKELFLSDHFDVQSAHTIEGKCIVHTFKNYTRLENVGAEDYYCRFEYKAATGAFTPDRVAVYCKCEMPYNPDDLMVQCEGCKDWYHPACVGMTIEEAKKLDHFVCAECSSDDDVKKSQNGFTSSPADDVKVRLSLFSHLLYRCSITYL

SEQ ID NO: 302 - DNA, 675 bp, Arabidopsis thaliana
atggcgaaaactcgacctggtgtcgcctccaaaattaagacgggaaggaaggagctggactcttataccatcaagggcaccaacaaagttgtgagagcgggagattgtgtgttgatgcgcccatcagatgctggtaaaccaccatatgtggcccgtgttgagaagattgaagctgatgcgaggaacaatgtgaaggtgcactgtcgatggtattaccgccctgaggagtcacttggtggtaggagacaatttcatggagccaaagagcttttcttgtctgaccattttgatgttcaaagtgcacacaccattgagggaaaatgcattgttcacaccttcaaaaactacacgaggcttgaaaacgttggggcagaggattattattgtagattcgagtacaaggctgctactggcgcatttacccctgatcgagttgctgtgtactgcaaatgtgaaatgccttacaatccagacgatctcatggtgcagtgtgaaggctgcaaagactggtatcatcctgcgtgtgttggcatgacgattgaagaagcaaagaagcttgatcactttgtatgtgctgaatgcagttctgatgacgatgtcaaaaaatcgcagaatgggtttacttcatctccagctgatgatgttaaggtggaaacgaagcgcagaaaaaggtaa

SEQ ID NO: 303 - protein, 224 aa, Arabidopsis thaliana
MAKTRPGVASKIKTGRKELDSYTIKGTNKVVRAGDCVLMRPSDAGKPPYVARVEKIEADARNNVKVHCRWYYRPEESLGGRRQFHGAKELFLSDHFDVQSAHTIEGKCIVHTFKNYTRLENVGAEDYYCRFEYKAATGAFTPDRVAVYCKCEMPYNPDDLMVQCEGCKDWYHPACVGMTIEEAKKLDHFVCAECSSDDDVKKSQNGFTSSPADDVKVETKRRKR

SEQ ID NO: 304 - DNA, 687 bp, Arabidopsis thaliana
atgcccaagcaaaaagctccaaggaagcagctcaagtcctataaactcaaacacatcaacaagagtattcaagagggagatgctgtgttgatgcggtcgtcggagcctggaaaaccgtcgtacgtagcgagggtagaggcgatcgagacggacgcgcgtggatcgcacgcgaaagttcgtgtgaggtggtattatcgccctgaggaatctatcggagggaggagacaattccatggagccaaggaggtttttctctctgaccacttcgattttcaaagcgccgatacgattgaaggaaagtgtaaggttcacagtttcagtagctacaccaaacttgactctgttggaaacgacgacttcttctgtcgtttcgagtacaattccactaccggcgcgtttgatcctgacagagtcaccgtgttctgcaagtgtgagatgccgtataacccagatgacttgatggtgcaatgcgaggagtgttctgagtggtttcatccttcttgtataggaacaacaatagaggaagctaaaaagccagataacttctactgcgaagagtgttccccacaacagcagaatttgcacaactctaattcaacttccaataacagagatgctaaggtgaatggaaagcgcagcctggaggtaactaaatcgaagaacaaacacactaagcgaccaggttaa

SEQ ID NO: 305 - protein, 228 aa, Arabidopsis thaliana
MPKQKAPRKQLKSYKLKHINKSIQEGDAVLMRSSEPGKPSYVARVEAIETDARGSHAKVRVRWYYRPEESIGGRRQFHGAKEVFLSDHFDFQSADTIEGKCKVHSFSSYTKLDSVGNDDFFCRFEYNSTTGAFDPDRVTVFCKCEMPYNPDDLMVQCEECSEWFHPSCIGTTIEEAKKPDNFYCEECSPQQQNLHNSNSTSNNRDAKVNGKRSLEVTKSKNKHTKRPG

SEQ ID NO: 306 - DNA, 582 bp, Arabidopsis thaliana
atgcgtccatcagatgctggtaaagctccttacgtggcgcgtgttgagaagattgaagcagatgcaaggaacaatgtgaaggtgcattgtcgatggtactattgtcctgaagaatcacatgggggaaggagacagctccatggagctaaagagcttttcttgtctgatcacttcgatgttcaaagtgcacacaccattgaaggaaaatgtatagttcacacctttaaaaactacacgaggcttgaaaatgttggagtggaagattattactgtatatttgactataaagctgctactggcgcgtttactcctgatcgagttgctgtgtactacaaatgtgaaatgccgtataactcagatgaactgatggagttactactatgtcattatagggttcacctagcgtgtgtaggcgtgacgattgaagaagccaagaagctggaacactttgtatgtgttgaatgcagctctgacgaagatggagtcaaaagatttcagaacgggtttgcttcatcaacaaccaatgatcttaagccaagcgccgaaaagatgatcgatgtaagagcctcttatgagttatga

SEQ ID NO: 307 - protein, 193 aa, Arabidopsis thaliana
MRPSDAGKAPYVARVEKIEADARNNVKVHCRWYYCPEESHGGRRQLHGAKELFLSDHFDVQSAHTIEGKCIVHTFKNYTRLENVGVEDYYCIFDYKAATGAFTPDRVAVYYKCEMPYNSDELMELLLCHYRVHLACVGVTIEEAKKLEHFVCVECSSDEDGVKRFQNGFASSTTNDLKPSAEKMIDVRASYEL

SEQ ID NO: 308 - DNA, 690 bp, Brassica napus
atgcccaagcaaaaagctcaaaagaagcaactcaaatcctacaaactcaaacacatcaacagaaccattcaagagggagatgcggttttgatgcggtcttcggagcctgggaaaccgtcgtacgtggcgagggtggaggcgatcgaggcgacggacgcgcgtggatcgaacgcgagggttcgcgtgaggtggtactaccgccccgaggagtccatgggagggaggaggcagttccacggagctaaggaggtgtttctttcggatcactttgacttgcagagcgctgatacgatcgaaggcaagtgtaaggttcacagtttcagtagctacacgaaactcagctccgtgggaaacgacgacttcttctgtcgttttgagtataattctgcaactggggcttttattcccgacagagtcgccgtattctgcaagtgtgagatgccgtacaaccctgatgacttgatggttcagtgcgaggagtgttctgagtggtttcacccttcttgtataggaacaacaatagaggcagctaaaaagctcgatcacttctactgtgaagagtgttccccggaacagcaggatttggataactctaattcgacttccaaaaccacagatgctaaggtgaatacaaagcgcagcctggaggtaagcaagacgaggaacaaacacgccaagcgatcaggttaa

SEQ ID NO: 309 - protein, 229 aa, Brassica napus
MPKQKAQKKQLKSYKLKHINRTIQEGDAVLMRSSEPGKPSYVARVEAIEATDARGSNARVRVRWYYRPEESMGGRRQFHGAKEVFLSDHFDLQSADTIEGKCKVHSFSSYTKLSSVGNDDFFCRFEYNSATGAFIPDRVAVFCKCEMPYNPDDLMVQCEECSEWFHPSCIGTTIEAAKKLDHFYCEECSPEQQDLDNSNSTSKTTDAKVNTKRSLEVSKTRNKHAKRSG

SEQ ID NO: 310 - DNA, 684 bp, Hordeum vulgare
atgtcaaagacgccggggaagtcgccgcggacgccgcgccggaccctggagtcctacaccatcaagggatccgacggcgtcatccgccctggagactctgtgctcatgaaggcgcccgactcatcaaagcctccatatgtggccaagattgaggaaatcgaggcagcaggacctcggggcgcaaatgtcaaggttaaagtgcggtggtactaccggccagaagagtctattggtgggcggaggccattccatggcgaaaaggaggtgttcctctccgaccaccaagatgtgcagagtgctgacaccatagagtgcaagtgcaatgtctacagcttccgggactacaccaagcttgctgctgtcaatcctgaggactatttttgccgcttcgagtacaagtcaatcacaggcagctttgtgcctgaccgcatagctgtgttttgcaagtgtgagatgccatacaaccctgacgatcttatgatccagtgtgaggaatgctctgattggtttcaccctgcttgtattggaaagaccataaaagaagcaaagaagcttgagaattttacatgcgaaggttgcgttgctgaaaatggaaatgcgaatggagtcaagaatgaaaattcgcatgaatctacaggcgagtcagatgagaagcaggtgcagtcgaagcggcgacggcggtga

SEQ ID NO: 311 - protein, 227 aa, Hordeum vulgare
MSKTPGKSPRTPRRTLESYTIKGSDGVIRPGDSVLMKAPDSSKPPYVAKIEEIEAAGPRGANVKVKVRWYYRPEESIGGRRPFHGEKEVFLSDHQDVQSADTIECKCNVYSFRDYTKLAAVNPEDYFCRFEYKSITGSFVPDRIAVFCKCEMPYNPDDLMIQCEECSDWFHPACIGKTIKEAKKLENFTCEGCVAENGNANGVKNENSHESTGESDEKQVQSKRRRR

SEQ ID NO: 312 - DNA, 651 bp, Hordeum vulgare
atggccaagaccaagcagggcaagagggacatcgactcctacaccatcaggggcaccaccaaggtcgtccgagtcggggactgcgtgctgatgcggccgtcggacacggacaacgcgccctacgtggcccgggtggagagcctggagtcggacggtcgggggagcgtgcgggtccgggtgcgttggtactaccggccggaggagtccaagggcggccgccggcagttccacggggccaaagagcttttcctctccgaccacttcgacacgcagagcgcacacactatcgagggcaagtgcatcgtccactccttcaagaactacaccaagctcgacaacgtcggccccgaggacttcttctgccgattcgagtacaaggcggccaccggggcattcacccccgaccgtgtcgccgtgtactgcaagtgcgagatgccgtacaacccagatgacctcatggtgcagtgtgagggatgcaaagactggttccatccaacctgtatgggaatgaccattgagcaggccaaaaagttagatactttcctgtgcgcagactgtgctaaagaaaatggtgcaaagagaccttcaaattcatacccgagttcaccaagttctgattctaaggttgagccgaaaaggcggaagaagtaa

SEQ ID NO: 313 - protein, 216 aa, Hordeum vulgare
MAKTKQGKRDIDSYTIRGTTKVVRVGDCVLMRPSDTDNAPYVARVESLESDGRGSVRVRVRWYYRPEESKGGRRQFHGAKELFLSDHFDTQSAHTIEGKCIVHSFKNYTKLDNVGPEDFFCRFEYKAATGAFTPDRVAVYCKCEMPYNPDDLMVQCEGCKDWFHPTCMGMTIEQAKKLDTFLCADCAKENGAKRPSNSYPSSPSSDSKVEPKRRKK

SEQ ID NO: 314 - DNA, 492 bp, Hordeum vulgare
atggccaagaccaagcagggcaagagggacatcgactcctacaccatcaggggcaccaccaaggtcgtccgagtcggggactgcgtgctgatgcggccgtcggacacggacaacgcgccctacgtggcccgggtggagagcctggagtcggacggtcgggggagcgtgcgggtccgggtgcgttggtactaccggccggaggagtccaagggcggccgacggcagttccacggggccaaagagcttttcctctccgaccacttcgacacgcagagcgcacacactatcgagggcaagtgcattggccactccttcaagaactacaccaagctcgacaacgttggccccgaggacttattctgccgattcgagtgcaaggcggtcaccggggcatacacccccaaccgggtagacagtgtctgtaagtgctatatgccttacaacccaaatgaccaaatggagcaaagtgtaggtatgcttacaccgatttag

SEQ ID NO: 315 - protein, 163 aa, Hordeum vulgare
MAKTKQGKRDIDSYTIRGTTKVVRVGDCVLMRPSDTDNAPYVARVESLESDGRGSVRVRVRWYYRPEESKGGRRQFHGAKELFLSDHFDTQSAHTIEGKCIGHSFKNYTKLDNVGPEDLFCRFECKAVTGAYTPNRVDSVCKCYMPYNPNDQMEQSVGMLTPI

SEQ ID NO: 316 - DNA, 657 bp, Hordeum vulgare
atggctaagacgcgcccgcccaagaggatactcgagtcctacaccatcaaggggtccgacaaagtcatcaagcctggggactgcgtgctaatgagatcagctgatacatcaaagccaccatatgtggcaaaagttgagtccatcgaggcagcagggtctcgaggcacaaatgtgagagtacgggttcgatggtactatcgtccagaagaatcgattggtgggaggcgaccatttcatggttcgaaagaggtattcctctctgaccactatgatgtacagagtgctgacacaatagagggaaaatgcaatgtccacagcttccgtagctacacaaagcttgattctgtcaatgccgaggacttcttctgccgctttgactacaaatcagcatctggcagttttgtgcccgaccgtattgctgtgttttgcaagtgtgagatgccgtacaatcctgatgaccttatgatccaatgtgaggaatgctccgactggtttcatccttcttgtattggaatgaccattaaagaagcaaagaaacgagaacactttttctgccagagctgtaccgatgaaaatgggaagacaactgagaattctcatgaagccacgtcacagtcagaagaaaagccggtggagtcgaaaaggcggagaaggtga

SEQ ID NO: 317 - protein, 218 aa, Hordeum vulgare
MAKTRPPKRILESYTIKGSDKVIKPGDCVLMRSADTSKPPYVAKVESIEAAGSRGTNVRVRVRWYYRPEESIGGRRPFHGSKEVFLSDHYDVQSADTIEGKCNVHSFRSYTKLDSVNAEDFFCRFDYKSASGSFVPDRIAVFCKCEMPYNPDDLMIQCEECSDWFHPSCIGMTIKEAKKREHFFCQSCTDENGKTTENSHEATSQSEEKPVESKRRRR

SEQ ID NO: 318 - DNA, 672 bp, Linum usitatissimum
atgagctcttttggatttgcggactctgttccaggcaccccttcgtatggccttggtgggaaaggaccattctcgtttgctgattctgtcccaggcactcctgcctacgattttggcaactctcgaagactcagtgaaggctcagacgatcactcctttgacaacttctccaggtttgattcatttaatttgaatgaaagcagcagcagctcattcccttcttcagggccttctcttgcaaggtttgattctgtgaggagcacgagagaatccgaacaagggtttggggcaccgtcgaggtttgattcgtttagagagtctggagactcggatcttggtcagggtttctcaaggtttgactcattcagggactctgatcagagccatgtccttccgagtttcgattcttttgacaatggtcaaggattcccttcaaggttcgattctttcagagattctggagatttcgatcacgggcgggggattacaaggtttgattcatttggtggtcagagctctggatttgattacgagcatggctcaaaggactctttgaacaagcatgggtttgatgatactgatgcatttgggtcaagtggaccgtatcgaacatcaacgtttgacggtggtgctactacaaagagaagttccgatgagtggaaagccttctag

SEQ ID NO: 319 - protein, 223 aa, Linum usitatissimum
MSSFGFADSVPGTPSYGLGGKGPFSFADSVPGTPAYDFGNSRRLSEGSDDHSFDNFSRFDSFNLNESSSSSFPSSGPSLARFDSVRSTRESEQGFGAPSRFDSFRESGDSDLGQGFSRFDSFRDSDQSHVLPSFDSFDNGQGFPSRFDSFRDSGDFDHGRGITRFDSFGGQSSGFDYEHGSKDSLNKHGFDDTDAFGSSGPYRTSTFDGGATTKRSSDEWKAF

SEQ ID NO: 320 - DNA, 651 bp, Oryza sativa
atggccaagaccaagcagggcaagaaggacgtcgaatcctacaccatcaagggcaccaccaagatcgtccgagtgggggattgcgtgctgatgcgggcgtcggacacggagaaggcgccgtacgtggggagggtggagaggctggagacggacgggagggggagcgtgcgggtgcgggtgcggtggtactaccggccggaggagtccaagggcgggaggaggcagttccatggcgccaaggagctgttcctctccgaccacttcgacacccagagcgcccacaccatcgagggcaagtgcgtcgtccactccttcaagaactacaccaagctcgacaacgtcggccccgaggacttcttctgccgcttcgagtacaaggccgccaccggcgccttcacccccgaccgcgtcgccgtgtactgcaagtgcgagatgccgtataacccggatgatctaatggtgcagtgcgagggatgcaaggactggttccatccatcttgtatgggaatgaccattgagcaggccaaaaaattagatcatttcctgtgcgcagattgtgtcaaagaaaatggcacgaagagaccttcaaattcatatccagcatcatcaaattctgattctaaggttgagccaaaaaagcggaagaggtaa

SEQ ID NO: 321 - protein, 216 aa, Oryza sativa
MAKTKQGKKDVESYTIKGTTKIVRVGDCVLMRASDTEKAPYVGRVERLETDGRGSVRVRVRWYYRPEESKGGRRQFHGAKELFLSDHFDTQSAHTIEGKCVVHSFKNYTKLDNVGPEDFFCRFEYKAATGAFTPDRVAVYCKCEMPYNPDDLMVQCEGCKDWFHPSCMGMTIEQAKKLDHFLCADCVKENGTKRPSNSYPASSNSDSKVEPKKRKR

SEQ ID NO: 322 - DNA, 651 bp, Oryza sativa
atggccaagaccaagcagggcaagcgggacgtcgactcctacaccatctccggcaccaacaaggtcgtacgagtgggggactgcgtgctgatgcggccggtggactcggacaaccagccgtacgtggcgcgggtggagaagatggagctggacgggcgcgggagcgtgcgggtgcgggtgcggtggtactaccggcccgaggagtccaagggcgggaggaggcagttccatggcgccaaggagctcttcctctccgaccacttcgacatgcagagcgccaacaccatcgagggcaagtgcgtcgtccactccttcaagaactacaccaagctcgacaacgtcggccccgaggacttcttctgccgcttcgagtacaaggccgccaccggcgccttcacccccgaccgcgtcgccgtatactgcaagtgtgagatgccatacaacccggatgatctcatggtgcagtgcgatgactgcaaggactggtttcatccttcatgcatgagcatgacgattgagcaggccaaaaaactagatcactttgtgtgctcagattgtgtcaaggaaaacggtgcaaagagaccttcacatgcatatgcaggttcaacaaagtatgagcctaaggctgagtcaaaaaggcagaggaggtga

SEQ ID NO: 323 - protein, 216 aa, Oryza sativa
MAKTKQGKRDVDSYTISGTNKVVRVGDCVLMRPVDSDNQPYVARVEKMELDGRGSVRVRVRWYYRPEESKGGRRQFHGAKELFLSDHFDMQSANTIEGKCVVHSFKNYTKLDNVGPEDFFCRFEYKAATGAFTPDRVAVYCKCEMPYNPDDLMVQCDDCKDWFHPSCMSMTIEQAKKLDHFVCSDCVKENGAKRPSHAYAGSTKYEPKAESKRQRR

SEQ ID NO: 324 - DNA, 657 bp, Oryza sativa
atggcgaagtcgcggccgcccaagcggatcctcgagtcctacaccatcaagggctccgacaaagtcatcaagcctggggactgtgtgctaatgagggcatctgatacatcaaagccaccctatgtggcaagagttgaggctattgaggctgcagggtcacgaggcacaaatgtgagagtacgggtgcggtggtactatcggccagaggagtccatgggtggaaggcgtccatttcatggtgccaaagaggtgttcctctcggatcactatgacgtacagagtgctgacaccatagagggaaagtgcaacgttcacagcttccgtagctacacaaagcttgattctgtcaatgctgaggacttcttctgtcgctttgagtacaaatcagccacaggaagcttcgtgcccgaccgcattgctgtgttctgcaagtgtgagatgccatacaatcctgatgaccttatgatccaatgtgaggaatgctctgattggtttcacccttcttgcattggaatgactattaaagatgcaaaaaaactagagcattttttctgccagagctgtactgcggaaaatggaaagatggctgagaattctcatgaagctacagcgcaatccgaagaaaagcaggtggagtcaaaaagacggagaaggtga

SEQ ID NO: 325 - protein, 218 aa, Oryza sativa
MAKSRPPKRILESYTIKGSDKVIKPGDCVLMRASDTSKPPYVARVEAIEAAGSRGTNVRVRVRWYYRPEESMGGRRPFHGAKEVFLSDHYDVQSADTIEGKCNVHSFRSYTKLDSVNAEDFFCRFEYKSATGSFVPDRIAVFCKCEMPYNPDDLMIQCEECSDWFHPSCIGMTIKDAKKLEHFFCQSCTAENGKMAENSHEATAQSEEKQVESKRRRR

SEQ ID NO: 326 - DNA, 657 bp, Oryza sativa; identical to SEQ ID NO: 324

SEQ ID NO: 327 - protein, 218 aa, Oryza sativa; identical to SEQ ID NO: 325

SEQ ID NO: 328 - DNA, 657 bp, Oryza sativa
atggccaagacgcggcagccgcagaagcgggtgctggagtcgttcaccatcaaggggcccgacggggtcatcaagcctggggatactgtgctaatgatggcacctgactcatcaaagaaaccatatgtggcaagggttgaggaaattgaggcaacaggacctcaagcctctcaagtgaagatcaaggtgcggtggtactaccgcccagaagagtccattggtggccggcggccattccatggttcgaaggaagtatttctttctgaccactatgattcgcagagtgctgacaccatagagggcaagtgttatgtccacacctttcgagattacaccaagcttcgatctgtcagcgctgaggacttcttttgccgctttgagtacaaatctgccacaggcagctttgtgcctgaccgtatagctgtgttttgcaaatgtgagatgccatacaatcctgataaccttatgatccaatgtgaggattgctctgactggtttcatccttcctgtgttgaaataaccatcaaagaagcgaagaaactagagcatttttactgtaaaagctgtattgctgaaaatggaaaggatctacaaaagtccaatggtgctactgtgcaatctgaagaaaaggtgcagtccaaacgacggcggaggtga

SEQ ID NO: 329 - protein, 218 aa, Oryza sativa
MAKTRQPQKRVLESFTIKGPDGVIKPGDTVLMMAPDSSKKPYVARVEEIEATGPQASQVKIKVRWYYRPEESIGGRRPFHGSKEVFLSDHYDSQSADTIEGKCYVHTFRDYTKLRSVSAEDFFCRFEYKSATGSFVPDRIAVFCKCEMPYNPDNLMIQCEDCSDWFHPSCVEITIKEAKKLEHFYCKSCIAENGKDLQKSNGATVQSEEKVQSKRRRR

SEQ ID NO: 330 - DNA, 681 bp, Physcomitrella patens
atggcgaagccgaagaacgggaagaagactctcgactcgtgcgtcattaaaggcactcggaaaattgtcaaagttggagatacagttctgatgcgcagcgaggatgcggataaacctccctatattgcaaaggtagagaagatcgagggtgatagtcgaggcaacgtgaaagtccgggtccggtggtactaccggccggaagaatccatgagcgggcgcaagcagttccatggacagaaggaggtttttctgtcggaccactatgacgtgcagagcgcggacacaatagaaggcaagtgcattgttcactctttcaagaactacacgaagttggagactgtgagtgctgaggactatttctgtcgattcgagtataaggcaaccactggcggtttcacccctgatcgcgtcgctgtgtattgcaagtgtgagatgccatacaaccctgaccacgtgatgctggaatgcaacagttgcaaagactggtttcacagacattgcgtgggcttgagcgaagagcaggtgaaacatgtggatagatacatttgccctacttgtgcccctgaaactgtgaagaaaagcaatggatcgtcacataagacaccagacgcgaaggtaacctccgttgaatttgcactagctgccttttcttcaattgcgttggtttttcattacacatag

SEQ ID NO: 331 - protein, 226 aa, Physcomitrella patens
MAKPKNGKKTLDSCVIKGTRKIVKVGDTVLMRSEDADKPPYIAKVEKIEGDSRGNVKVRVRWYYRPEESMSGRKQFHGQKEVFLSDHYDVQSADTIEGKCIVHSFKNYTKLETVSAEDYFCRFEYKATTGGFTPDRVAVYCKCEMPYNPDHVMLECNSCKDWFHRHCVGLSEEQVKHVDRYICPTCAPETVKKSNGSSHKTPDAKVTSVEFALAAFSSIALVFHYT

SEQ ID NO: 332 - DNA, 720 bp, Physcomitrella patens
atggcgaagtccaaagctgctaagaaatctctagactcgtatactgtgaaaggcactaacaaagtcgtgaaagtgggagataccgtcttaatgcgtggacaagatccagagaaaccaccttatgttgcgaagatagagaaaatcgaagctgacggtagaaataacagcaacgtgaaggtccgttgtcgatggtattatcgaccggaagaatcaatgggaggcaggagacaatttcacggaacgaaggagctctttctttccgatcattatgatatacaaagcgcggataccatagagggaaaatgcactgtgcacacgtttaaaaattacacaaagttggaaagtgttggtgcagaagactatttctgccggttcgaatataaagcatcaactggcgggttcactcctgatcgagttgctgtttattgcaagtgcgagatgccttacaatcctgatgacttgatggttcaatgtgaaatctgcaaagactggttccacccatcgtgcatgagtatgacaccggatcaggtgaagaaaatggaaaagtttttctgccctgattgtatttctcaatccggagagaagaaggtgcggcaatcgtctcctaggagttcacctgctactgaccatgtcaaggtatatattctctgcattattttgatgttgctggcattaccttatggcccaagcttgctggcattatttagtgtattctgctga

SEQ ID NO: 333 - protein, 239 aa, Physcomitrella patens
MAKSKAAKKSLDSYTVKGTNKVVKVGDTVLMRGQDPEKPPYVAKIEKIEADGRNNSNVKVRCRWYYRPEESMGGRRQFHGTKELFLSDHYDIQSADTIEGKCTVHTFKNYTKLESVGAEDYFCRFEYKASTGGFTPDRVAVYCKCEMPYNPDDLMVQCEICKDWFHPSCMSMTPDQVKKMEKFFCPDCISQSGEKKVRQSSPRSSPATDHVKVYILCIILMLLALPYGPSLLALFSVFC

SEQ ID NO: 334 - DNA, 660 bp, Physcomitrella patens
atggcgaagtcgaaaggtgccaagaaagctctcgactcgtacaccgtgaaaggcacacagaaggtcgtgaaagtgggagattgtgtcttgatgcgtgggcaagatcctgataagccaccttacgttgccaagatagagaagattgaggctgacaacagaaacaatactaaagtacgggtacgatggtattatcggcctgaagagtcaatgggagggaggcgacaatttcatggttcaaaggagcttttcttgtcagatcactacgatattcaaagtgcggacactatagagggcaagtgcattgttcatacgttcaaaaattacactaagcttgacagtgtcggtactgaagattacttctgtcgctttgaatacaaggcttctactggcggattcactcctgatcgagtggctgtgtattgtaaatgtgagatgccttataatccagatgatttgatggttcaatgtgagacttgcaaagattggtttcacccttcttgcatgagcttcacaccagatcaagtgaagcgtatggagaaatttgtttgtcctgattgttccttgccagatggggacaggaagttgcgccaatcttctccaggatcgtcaccaacacctgaacatgttcataagccggaggcaaagcggcggaagaggtga

SEQ ID NO: 335 - protein, 219 aa, Physcomitrella patens
MAKSKGAKKALDSYTVKGTQKVVKVGDCVLMRGQDPDKPPYVAKIEKIEADNRNNTKVRVRWYYRPEESMGGRRQFHGSKELFLSDHYDIQSADTIEGKCIVHTFKNYTKLDSVGTEDYFCRFEYKASTGGFTPDRVAVYCKCEMPYNPDDLMVQCETCKDWFHPSCMSFTPDQVKRMEKFVCPDCSLPDGDRKLRQSSPGSSPTPEHVHKPEAKRRKR

SEQ ID NO: 336 - DNA, 642 bp, Physcomitrella patens
atggcaaagccgaagaatgggaagaagactttggactcatgcgtcattaagggcactcggaaaattgttaaagttggagatacagttctgatgcgcagtgaggatccagataaacctccatatattgccaaagtagagaatatcgagggcgatagccggggcaatgtgaaggttcaggtgcgatggtattaccgcccagaagaatcaatgagtgggcgcaagcagttccatggacagaaagaggtttttctgtccgaccactacgacgtgcagagcgcggacacaatagaaggcaaatgcattgtgcactcttttaagaactacacgaaactggaggctgtgagtgctgaggactacttctgtcggtttgagtacaaggcaactactggtggtttcactcctgaccgcgtcgctgtgtactgtaagtgcgagatgccttacaaccccgaccatgtgatgctggaatgcaacagttgcaaagactggttccataggcattgcgtgggattgagcgaggagcaggttaaacacgtggatagatacatttgtcctggttgtgctcctgaaactgtgaagaaaagtaatggaccatcacatatgaccccagacgccaagccagagccaaaacgtcagaggaggtga

SEQ ID NO: 337 - protein, 213 aa, Physcomitrella patens
MAKPKNGKKTLDSCVIKGTRKIVKVGDTVLMRSEDPDKPPYIAKVENIEGDSRGNVKVQVRWYYRPEESMSGRKQFHGQKEVFLSDHYDVQSADTIEGKCIVHSFKNYTKLEAVSAEDYFCRFEYKATTGGFTPDRVAVYCKCEMPYNPDHVMLECNSCKDWFHRHCVGLSEEQVKHVDRYICPGCAPETVKKSNGPSHMTPDAKPEPKRQRR

SEQ ID NO: 338 - DNA, 570 bp, Physcomitrella patens
atgacaaagaagcgtaccactaaaagtcggctggattactaccgcattgccaacactcagaaaattatcaaacctggagatacggtgactttgcggccaccagatctcaccacacccccgtatgtggcaaggattgaactcattgagcttgacgcggcagagaaaataacgctgaaagtgcgttggtactatcgacctgaagagtcggcaggtgggcgtaggcaatttcatggctcaaaagagctttttctttctgaccactacgacgtttgcagccccgaggccgtagaaaacaagtgcactatccacactttcaaagattacacacgcctggaggatgtaggaacagatgattatttctgccgattcgattacaatgctagatctgggacattttcgccagatcgtgttgccgtgtattgtaagtgtgagatgccctacaatcccgatgatttaatggttcaatgcgagaactgtaaagactggtttcatccgaaatgtgtaatgctttcttccgaagacataaaaaatgtcaagaactttcattgccctgactgtatcaatagttga

SEQ ID NO: 339 - protein, 189 aa, Physcomitrella patens
MTKKRTTKSRLDYYRIANTQKIIKPGDTVTLRPPDLTTPPYVARIELIELDAAEKITLKVRWYYRPEESAGGRRQFHGSKELFLSDHYDVCSPEAVENKCTIHTFKDYTRLEDVGTDDYFCRFDYNARSGTFSPDRVAVYCKCEMPYNPDDLMVQCENCKDWFHPKCVMLSSEDIKNVKNFHCPDCINS

SEQ ID NO: 340 - DNA, 648 bp, Populus trichocarpa
atggctaaagctaaagcaccaagacgcactcttgactcttacactgttaaacccatcaacaaaaccgttaaacctggagattgcgtgttgatgcggccatcggatccgtcgaagccttcttacgtggcaaagattgagcggatcgaatccgacggtagagggcccaacgtgagagtacgggtgcggtggtattaccggccggaggaatcaatcggtggtcgccggcagtttcatggctcaaaggaggtttttctatccgatcattatgatactcagagtgcagatacgattgaaggaaagtgtatggttcatagtttcaagaattacacgaagcttgatgctgttgggaacgatgatttcttttgtcgttttgagtataattcgtctactggtgcttttaatcctgatagagttgccgtgtattgcaaatgtgagatgccttacaatcctgatgacttgatggttcaatgtgaaggctgcagtgactggtttcatcctgcttgtatagaaatgtctgcagaggaagctaaaagacttgatcatttcttctgtgaaaactgctcatctgaaggccagaagaagctgcagaattcccacaataccagacaatcagatgcaaaggcggaaacaaagaggcgccggaggtga

SEQ ID NO: 341 - protein, 215 aa, Populus trichocarpa
MAKAKAPRRTLDSYTVKPINKTVKPGDCVLMRPSDPSKPSYVAKIERIESDGRGPNVRVRVRWYYRPEESIGGRRQFHGSKEVFLSDHYDTQSADTIEGKCMVHSFKNYTKLDAVGNDDFFCRFEYNSSTGAFNPDRVAVYCKCEMPYNPDDLMVQCEGCSDWFHPACIEMSAEEAKRLDHFFCENCSSEGQKKLQNSHNTRQSDAKAETKRRRR

SEQ ID NO: 342 - DNA, 651 bp, Populus trichocarpa
atggccaaaaccaaacctggcaaaaaagaccttgattcttacactatcaaaggcaccaacaaagttgttagacctggtgattgtgtgttgatgcgcccatcggatacagataagcttccatacgtggcacgtatagagaaaatcgaggcagatcatcgaaacaacgttaaagttcgtgtacggtggtactaccggccggaggaatccattgggggacgccgtcaattccacggagcaaaagagttattcctgtcagaccactatgatgtgcaaagtgcacatacaatcgaaggcaagtgcacagtgcactccttcaagaactacactaagcttgaaaatgttggagctgaggattacttttgtaggttcgaatacaaggcttccactggtggtttcactcccgatcgtgtagctgtgtactgtaagtgtgaaatgccatacaatccggatgatctcatggtgcaatgcgagggatgcaaagattggtttcatccttcttgtatgggtatgacaattgaagaagccaaaaaatcagatcactttctgtgctccgactgctcatctgatgatgatgcaaaaagatctttgaatgtattcccagtatcaccatcacttgaggttaaggtggagacaaaacgcaggaagagatga

SEQ ID NO: 343 - protein, 216 aa, Populus trichocarpa
MAKTKPGKKDLDSYTIKGTNKVVRPGDCVLMRPSDTDKLPYVARIEKIEADHRNNVKVRVRWYYRPEESIGGRRQFHGAKELFLSDHYDVQSAHTIEGKCTVHSFKNYTKLENVGAEDYFCRFEYKASTGGFTPDRVAVYCKCEMPYNPDDLMVQCEGCKDWFHPSCMGMTIEEAKKSDHFLCSDCSSDDDAKRSLNVFPVSPSLEVKVETKRRKR

SEQ ID NO: 344 - DNA, 672 bp, Populus trichocarpa
atggctaaaaccagaccaggaggcatcatctccaagcctaaaacaggcaagagggaccttgaatcctacacaattcgtggcactaccaaagttgttagagcgggggattgtgtattgatgagaccatctgatactggtaggccttcatacgtggcaaaaattgaggcgattgaggctgatagcagaaacaatgtgaaggttagagtgagatggtactataggccagaagagtctttgggagggcgcaggcagtttcatggagcaaaagagttgttcttatcagatcattatgatgtacaaagtgctcacaccattgaagggaagtgtatagttcactcttttaagaactatacaaagctcgagaatgttggagctgaggattattattgtaggtttgagtataaggctgctactggaggtttcacaccagaccgtgttgctgtgtattgcaaatgtgagatgccatataacccagatgatctcatggtgcaatgtgagggttgcaaggactggtatcatcctgcttgtgttgacatgacaattgaagaggcaaagaaattggatcacttcatgtgttctgagtgtgcatctgatgatgatgtgaaaagatcacagaatggattttcagcatcatcattagctgaagtagagaacaagcgccggaagagatga

SEQ ID NO: 345 - protein, 223 aa, Populus trichocarpa
MAKTRPGGIISKPKTGKRDLESYTIRGTTKVVRAGDCVLMRPSDTGRPSYVAKIEAIEADSRNNVKVRVRWYYRPEESLGGRRQFHGAKELFLSDHYDVQSAHTIEGKCIVHSFKNYTKLENVGAEDYYCRFEYKAATGGFTPDRVAVYCKCEMPYNPDDLMVQCEGCKDWYHPACVDMTIEEAKKLDHFMCSECASDDDVKRSQNGFSASSLAEVENKRRKR

SEQ ID NO: 346 - DNA, 489 bp, Populus trichocarpa
atggccaaaaccaaacctggcaaaaaagaccttgattcctacactatcaaaggcaccaacaaagttgttagacctggtgattgtgtgttgatgcgcccatcggacaccgataagcttccatacgtggcacttgtagagaaaatcgaggcagatcatagaaacaacgttaaagttcgtgtacggtggtactaccggccggaggaatccattgggggacgccgtcaattccacggagccaaagagttattcttgtcagaccaccatgatatgcaaagtgcacacacaatcgaaggcaagtgcacagtgcactccttcaagaactatagtaagcttgagaatgttggagctgaggattacttttgtaggttcgagtacaaggcttccaccggtgggttcactcctgatcgtgtagctgtgtactgtaagtgcgagatgccatacaatccagacgatctcatggtgcaatgcgagggatgcaaagattggtaa

SEQ ID NO: 347 - protein, 162 aa, Populus trichocarpa
MAKTKPGKKDLDSYTIKGTNKVVRPGDCVLMRPSDTDKLPYVALVEKIEADHRNNVKVRVRWYYRPEESIGGRRQFHGAKELFLSDHHDMQSAHTIEGKCTVHSFKNYSKLENVGAEDYFCRFEYKASTGGFTPDRVAVYCKCEMPYNPDDLMVQCEGCKDW

SEQ ID NO: 348 - DNA, 678 bp, Populus trichocarpa
atggctaaaaccagaccaggaggcctcatctccaagcctaaaacaggcaagagggaccttgactcctacacaattcgcggcactaccaaagttgtcagagtgggggattgtgtaatgatgagaccatctgatactggtaggccttcatacgtggcaagaattgaggggatggaggctgacagtagaaacaatgtgaaggttagagtgagatggtactataggccagaagagtctttaggagggcgcaggcagtttcatggagcgaaagagttgttcttatcagatcattatgatgtgcaaagtgctcacactattgaagggaagtgtatagttcactcttttaagaactataccaagcttgaaaatgttggagctgaggattattattgtaggtttgagtataaggctgctactggaggtttcacaccggaccgtgttgctgtgtattgcaaatgtgagatgccatataacccagatgatcttatggtgcaatgtgagggttgcaaggactggtatcatcctgcttgtgtggacatgacaattgaagaggcaaaaaaattggatcactttgtgtgttctgaatgtgcatctgatgatgatgtcaaaagatcacaaaatgggttttcagtgtcatcagttactgatgtcaaggtagaaaacaagcgccggaagagatga

SEQ ID NO: 349 - protein, 225 aa, Populus trichocarpa
MAKTRPGGLISKPKTGKRDLDSYTIRGTTKVVRVGDCVMMRPSDTGRPSYVARIEGMEADSRNNVKVRVRWYYRPEESLGGRRQFHGAKELFLSDHYDVQSAHTIEGKCIVHSFKNYTKLENVGAEDYYCRFEYKAATGGFTPDRVAVYCKCEMPYNPDDLMVQCEGCKDWYHPACVDMTIEEAKKLDHFVCSECASDDDVKRSQNGFSVSSVTDVKVENKRRKR

SEQ ID NO: 350 - DNA, 489 bp, Populus trichocarpa; identical to SEQ ID NO: 346

SEQ ID NO: 351 - protein, 162 aa, Populus trichocarpa; identical to SEQ ID NO: 347

SEQ ID NO: 352 - DNA, 651 bp, Solanum lycopersicum
atggctaaaactcgtacaaatcgtcgaaccctagattcttacactgtcaaatccatcaacaagaccgttcgagccggcgactgcgtgttgatgagagcgtcggagtcgtcaaagccgtcgtacgttgctcgagttgagaagattgagtccgacaatagaggtggcaacgtcagggttcacgtccggtggtactaccgtccggaggagtcgatcggcggccgacgtcagtttcacggctccaaggaactttttatgtccgatcaccgagatatacaaagtgccgacacaattgaaggcaagtgtacggtccacacattcaagagctacaccaaactcgacgctgttgggaacgaagacttcttttgccgatttgactacaattcttctaccggagcatttaatcctgacagagttgctgtgtactgtaaatgtgaaatgccatacaatcctgatgacctcatggttcaatgtgagggctgcagtgactggtttcaccctacttgtatagacatgacgccagaggaagccaagagacttgaccacttcttttgccaaaattgttcatctgaagatcagaagaaattgctaaattctcatgctacttcaagacatgctgatataaaggttgagtccaaacgccgacggaggtaa

SEQ ID NO: 353 - protein, 216 aa, Solanum lycopersicum
MAKTRTNRRTLDSYTVKSINKTVRAGDCVLMRASESSKPSYVARVEKIESDNRGGNVRVHVRWYYRPEESIGGRRQFHGSKELFMSDHRDIQSADTIEGKCTVHTFKSYTKLDAVGNEDFFCRFDYNSSTGAFNPDRVAVYCKCEMPYNPDDLMVQCEGCSDWFHPTCIDMTPEEAKRLDHFFCQNCSSEDQKKLLNSHATSRHADIKVESKRRRR

SEQ ID NO: 354 - DNA, 678 bp, Solanum lycopersicum
atggcaaagactaaaccagggaaaaaggaccttgattcttactctatcaagggtaccaacaaagtcgtacgagttggtgattgtgtattgatgagaccatccgattcggataagcccccatacgtggcaaaagtagataaaattgaggcagaccatcgcaacaatgtgaaggtccgagttcagtggtactaccgccctgaggagtcagttggtggacgcagacagttccatggggctaaagagctgttcttgtccgatcactatgattttcagagtgcacacacaatcgaagggaagtgcatagtgcactccttcaagaactacacaaagctggagaatgtgggccctgaggattacttttgtaggttcgactacaaagctgccacaggagggtttactcctgatcgtgttgctgtgtattgcaagtgtgaaatgccctacaacccagatgatctcatggttcaatgtgaagggtgtaaagactggttccatcctatctgtatgggtatgaccattgatgaagcaaagaaattagaccctttcttgtggtctgactgttcatcagaagatgatgctaaacgacccttgaactctttccatgttgagccaaagctggtcgttagtttatttacgtcaaaaggaagtggaggattgcatgttcagtcacttgatttgtga

SEQ ID NO: 355 - protein, 225 aa, Solanum lycopersicum
MAKTKPGKKDLDSYSIKGTNKVVRVGDCVLMRPSDSDKPPYVAKVDKIEADHRNNVKVRVQWYYRPEESVGGRRQFHGAKELFLSDHYDFQSAHTIEGKCIVHSFKNYTKLENVGPEDYFCRFDYKAATGGFTPDRVAVYCKCEMPYNPDDLMVQCEGCKDWFHPICMGMTIDEAKKLDPFLWSDCSSEDDAKRPLNSFHVEPKLVVSLFTSKGSGGLHVQSLDL

SEQ ID NO: 356 - DNA, 777 bp, Arabidopsis thaliana
atgcccaagcaaaaagctccaaggaagcagctcaagtcctataaactcaaacacatcaacaagagtattcaagagggagatgctgtgttgatgcggtcgtcggagcctggaaaaccgtcgtacgtagcgagggtagaggcgatcgagacggacgcgcgtggatcgcacgcgaaagttcgtgtgaggtggtattatcgccctgaggaatctatcggagggaggagacaattccatggagccaaggaggtttttctctctgaccacttcgattttcaaagcgccgatacgattgaaggaaagtgtaaggttcacagtttcagtagctacaccaaacttgactctgttggaaacgacgacttcttctgtcgtttcgagtacaattccactaccggcgcgtttgatcctgacagagtcaccgtgttctgcaagtgtgagatgccgtataacccagatgacttgatggtgcaatgcgaggagtgttctgagtggtttcatccttcttgtataggaacaacaatagaggaagctaaaaagccagataacttctactgcgaagagtgttccccacaacagcagaatttgcacaactctaattcaacttccaataacagagatgctaaggtatttctctatttctcatttcagaaaatatctttagtttttgagggatggtcaaacccgttgcaaataggcttgaataaatttaaggtatttaagttgaccgttcgttccacatataaagctagccttgccaacaattgtaagctcttggactga

SEQ ID NO: 357 - protein, 258 aa, Arabidopsis thaliana
MPKQKAPRKQLKSYKLKHINKSIQEGDAVLMRSSEPGKPSYVARVEAIETDARGSHAKVRVRWYYRPEESIGGRRQFHGAKEVFLSDHFDFQSADTIEGKCKVHSFSSYTKLDSVGNDDFFCRFEYNSTTGAFDPDRVTVFCKCEMPYNPDDLMVQCEECSEWFHPSCIGTTIEEAKKPDNFYCEECSPQQQNLHNSNSTSNNRDAKVFLYFSFQKISLVFEGWSNPLQIGLNKFKVFKLTVRSTYKASLANNCKLLD

SEQ ID NO: 358 - DNA, 651 bp, Triticum aestivum
atggccaagaccaagcagggcaagagggacatcgactcctacaccatcaggggcaccaccaaggtcgtccgagtcggggactgcgtgctgatgcggccgtcggacacggacaacgcgccctacgtggcccgggtggagagcctggagtcggacggtcgggggagcgtgcgggtgcgggtccgctggtactaccggccggaggagtccaagggcggccgccggcagttccacggggccaaagagctcttcctctccgaccacttcgacacgcagagcgcacacaccatcgagggcaagtgcatcgttcactccttcaagaactacaccaagctcgacaacgtcggcccggaggacttcttctgccgattcgagtacaaggcggccaccggagcgttcacccccgaccgtgtcgccgtgtactgtaagtgcgagatgccgtacaacccagatgacctcatggtgcaatgcgagggatgcaaagactggttccatccaacctgtatgggaatgaccattgagcaggccaaaaagttggatactttcctgtgtgcggattgtgctaaagaaaatggtgcaaagaggccttcaaattcatacccgagttcaccaagttctgattctaaggttgagccgaaaaggcggaaatggtaa

SEQ ID NO: 359 - protein, 216 aa, Triticum aestivum
MAKTKQGKRDIDSYTIRGTTKVVRVGDCVLMRPSDTDNAPYVARVESLESDGRGSVRVRVRWYYRPEESKGGRRQFHGAKELFLSDHFDTQSAHTIEGKCIVHSFKNYTKLDNVGPEDFFCRFEYKAATGAFTPDRVAVYCKCEMPYNPDDLMVQCEGCKDWFHPTCMGMTIEQAKKLDTFLCADCAKENGAKRPSNSYPSSPSSDSKVEPKRRKW

SEQ ID NO: 360 - DNA, 651 bp, Triticum aestivum
atggccaagaccaagcagggcaagagggacatcgactcctacaccatcaggggcaccaccaaggtcgtccgagtcggggactgcgtgctgatgcggccgtcggacacggacaacgcgccctacgtggcccgggtggagagcctggagtcggacggtcgggggagcgtgcgggtgcgggtccgctggtactaccggccggaggagtccaagggcggccgccggcagttccacggggccaaagagctcttcctctccgaccacttcgacacgcagagcgcacacaccatcgagggcaagtgcatcgttcactccttcaagaactacaccaagctcgacaacgtcggcccggaagacttcttctgccgattcgagtacaaggcggccaccggagcgttcacccccgaccgtgtcgccgtgtactgtaagtgcgagatgccgtacaacccagatgacctcatggtgcaatgcgagggatgcaaagactggttccatccaacctgtatgggaatgaccattgagcaggccaaaaagttagatactttcctgtgcgcggattgtgctaaagaaaatggtgcaaagagaccttcaaattcatacccgagttcaccaagttctgattctaaggttgagccgaaaaggcggaagaggtaa

SEQ ID NO: 361 - protein, 216 aa, Triticum aestivum
MAKTKQGKRDIDSYTIRGTTKVVRVGDCVLMRPSDTDNAPYVARVESLESDGRGSVRVRVRWYYRPEESKGGRRQFHGAKELFLSDHFDTQSAHTIEGKCIVHSFKNYTKLDNVGPEDFFCRFEYKAATGAFTPDRVAVYCKCEMPYNPDDLMVQCEGCKDWFHPTCMGMTIEQAKKLDTFLCADCAKENGAKRPSNSYPSSPSSDSKVEPKRRKR

SEQ ID NO: 362 - DNA, 540 bp, Triticum aestivum
atgtcaaagacgccggggaagacgccgcggacgcccaggcggatcctggagtcctacaccatcaagggatccgacggcgtcatccgccctggggactctgtgctgatgaaggcgcccgacacatcaaactctccgtatgtggccatgattgaggaaatcctggcagtaggacctcggggcgcacatgtccaggtcaaagtgcgctggtgctaccgcaccggaggagtccattggtgggcgcacgccattccatgcgcgaaaaggaggtgtttctctctgaccaccaagatgtgcagagtgctgacatcgtacactggaactgcttcgtctacagcttccgggactacaccaagccttttggtgtctgtcctgatggactattttggccgattcgtgttccatgtcaatcacaggccgctttgtaccgtgtctggttgctgtgttttggtcattttgaattggcttgtaaccctggctgaccttttcatcccactgtgtggaaatgtccctcttggttccccctttcgtgctttgggctga

SEQ ID NO: 363 - protein, 179 aa, Triticum aestivum
MSKTPGKTPRTPRRILESYTIKGSDGVIRPGDSVLMKAPDTSNSPYVAMIEEILAVGPRGAHVQVKVRWCYRTGGVHWWAHAIPCAKRRCFSLTTKMCRVLTSYTGTASSTASGTTPSLLVSVLMDYFGRFVFHVNHRPLCTVSGCCVLVILNWLVTLADLFIPLCGNVPLGSPFRALG

SEQ ID NO: 364 - DNA, 651 bp, Triticum aestivum
atggccaagaccaagcagggcaagagggacatcgactcctacaccatcaggggcaccaccaaggtcgtccgagtcggggactgcgtgctgatgcggccgtcggacacggacaacgcgccctacgtggcccgggtggagagcctggagtcgaacggtcgggggagcgtgcgggtgcgggtccgctggtactaccggccggaggagtccaagggcggccgccggcagttccacggggccaaagagctcttcctctccgaccacttcgacacgcagagcgcacacaccatcgagggcaagtgcatcgttcactccttcaagaactacaccaagctcgacaacgtcggcccggaagacttcttctgccgattcgagtacaaggcggccaccggagcgttcacccccgaccgtgtcgccgtgtactgtaagtgcgagatgccgtacaacccagatgacctcatggtgcaatgcgagggatgcaaagactggttccatccaacctgtatgggaatgaccattgagcaggccaaaaagttagatactttcctgtgcgcggattgtgctaaagaaaatggtgcaaagagaccttcaaattcatacccgagttcaccaagttctgattctaaggttgagccgaaaaggcggaaaaagtaa

SEQ ID NO: 365 - protein, 216 aa, Triticum aestivum
MAKTKQGKRDIDSYTIRGTTKVVRVGDCVLMRPSDTDNAPYVARVESLESNGRGSVRVRVRWYYRPEESKGGRRQFHGAKELFLSDHFDTQSAHTIEGKCIVHSFKNYTKLDNVGPEDFFCRFEYKAATGAFTPDRVAVYCKCEMPYNPDDLMVQCEGCKDWFHPTCMGMTIEQAKKLDTFLCADCAKENGAKRPSNSYPSSPSSDSKVEPKRRKK

SEQ ID NO: 366 - DNA, 651 bp, Zea mays
atggccaagacgaagcaagggaagcgggatgtcgacgcctataccatcaagggcaccaacaaggtggtccgagtgggggactgcgtgctgatgcggccagcggacacggacaacccgccgtacgtggcgcgggtggagcggatggagtcggacgggcgcggcagcgtgagggtgcgggtgcgctggtactaccgccccgaggaggccaagggcggccgacgcccgttccacggtgccaaggagctcttcctctccgaccacttcgacacgcagagcgcccacaccattgagggcaagtgcatcgttcactccttcaagagctacaccaagctcgacaacgttggtccggaggacttctactgccgatttgactacaaggccgccaccggtgcattcacccccgaccgtgtcgccgtatattgcaagtgtgagatgccgtacaacccggatgacctcatggtgcagtgtgaaggatgcaaggactggttccatccgtcttgtatgggaatgaccattgagcaagcaaaaaagatagatcattacatgtgctcggattgtgctaaagaaaatggtgcaaagagaccctcaaattcatactcagtttcaccaaactcagattctaagattgaatcaaagaggcgcaagagataa

SEQ ID NO: 367 - protein, 216 aa, Zea mays
MAKTKQGKRDVDAYTIKGTNKVVRVGDCVLMRPADTDNPPYVARVERMESDGRGSVRVRVRWYYRPEEAKGGRRPFHGAKELFLSDHFDTQSAHTIEGKCIVHSFKSYTKLDNVGPEDFYCRFDYKAATGAFTPDRVAVYCKCEMPYNPDDLMVQCEGCKDWFHPSCMGMTIEQAKKIDHYMCSDCAKENGAKRPSNSYSVSPNSDSKIESKRRKR

SEQ ID NO: 368 - DNA, 660 bp, Zea mays
atggcggggaagtcgcgaccgcccaagcggatcctcgagtcctataccatcaagggttcggacagagtcatcaagcctggcgattgcgtgctaatgagggcatctgatgcttcaaagccaccttatgtggcaagagttgaggcaattgaagcagcaggatctcgaggcaccaatgtgagagtacgagtgcggtggtattatcgaccagaggagtccataggtggtcggcggccatttcatggttccaaggaggttttcctctctgaccactatgatgtacaaagtgctgacaccattgaggggaaatgcaatgtccacagcttccgtagctatacaaagcttgattctgtcaatgctgaggatttcttctgccgcttcgagtataaatcagctactggcagctttgtaccagatcgtatagcagtgttttgcaagtgcgagatgccatacaatccagatgaccttatgatccaatgcgaggaatgttctgactggtttcaccctgcttgcattgggatgacaatcaaagaagcaaagaaactcgagcattttttctgccagacctgtacagctgaaaatggtaagatggttgagaattcacatgaagctacagcgcaatcagaagaaaagccggtggagtcaaaaaggcggcgaaggtga

SEQ ID NO: 369 - protein, 219 aa, Zea mays
MAGKSRPPKRILESYTIKGSDRVIKPGDCVLMRASDASKPPYVARVEAIEAAGSRGTNVRVRVRWYYRPEESIGGRRPFHGSKEVFLSDHYDVQSADTIEGKCNVHSFRSYTKLDSVNAEDFFCRFEYKSATGSFVPDRIAVFCKCEMPYNPDDLMIQCEECSDWFHPACIGMTIKEAKKLEHFFCQTCTAENGKMVENSHEATAQSEEKPVESKRRRR

SEQ ID NO: 370 - DNA, 660 bp, Zea mays; identical to SEQ ID NO: 368

SEQ ID NO: 371 - protein, 219 aa, Zea mays; identical to SEQ ID NO: 369

SEQ ID NO: 372 - DNA, 651 bp, Zea mays; identical to SEQ ID NO: 366

SEQ ID NO: 373 - protein, 216 aa, Zea mays; identical to SEQ ID NO: 367

SEQ ID NO: 374 - protein, 113 aa, Artificial sequence
  BAH domain
GDCVLMRASDTSKPPYVARVEAIEAAGSRGTNVRVRVRWYYRPEESMGGRRPFHGAKEVFLSDHYDVQSADTIEGKCNVHSFRSYTKLDSVNAEDFFCRFEYKSATGSFVPDR

SEQ ID NO: 375 - protein, 46 aa, Artificial sequence
  PHD domain
CKCEMPYNPDDLMIQCEECSDWFHPSCIGMTIKDAKKLEHFFCQSC

SEQ ID NO: 376 - protein, 9 aa, Artificial sequence
  motif 10
VRVRVRWYY

SEQ ID NO: 377 - protein, 4 aa, Artificial sequence
  motif 11
RPEE

SEQ ID NO: 378 - protein, 6 aa, Artificial sequence
  motif 12
TIEGKC

SEQ ID NO: 379 - protein, 7 aa, Artificial sequence
  motif 13
GDCVLMR

SEQ ID NO: 380 - protein, 4 aa, Artificial sequence
  motif 14
YVAR

SEQ ID NO: 381 - protein, 4 aa, Artificial sequence
  motif 15
GAKE

SEQ ID NO: 382 - protein, 5 aa, Artificial sequence
  motif 16
CRFEY

SEQ ID NO: 383 - protein, 4 aa, Artificial sequence
  motif 17
HEAT

SEQ ID NO: 384 - DNA, 50 bp, Artificial sequence
  primer 3
ggggacaagtttgtacaaaaaagcaggcttaaacaatggcgaagtcgcgg

SEQ ID NO: 385 - DNA, 50 bp, Artificial sequence
  primer 4
ggggaccactttgtacaagaaagctgggttccaggtgtatctcgtcaatg

SEQ ID NO: 386 - DNA, 2194 bp, Oryza sativa; identical to SEQ ID NO: 103

SEQ ID NO: 387 - DNA, 1443 bp, Populus trichocarpa
atggacccaccacctccctcattattgatccatccaccactcccaccgtcctcccctccaccacccaccaccgccatcccctccaccactgaaaccatcccccatttagctcctcttcccaaccctgcccccgctgtaacccagccttcatatgctgagatgatatattcagcgattacagctttgaaggaacaagatgggtcaagcaggatagctatagcaaagtatatagagagagcttatcctggcttaccctcaaatcactctgacttgttgacacaccacttaaaacgtttgaaaaatagtggggcgcttgttttgaacaagaaatcttacatgttacccagatctgacagtaacgcaaacatcaccactactacacctactgtctctaccagccctactcagattcagccacagtatgctgttcctgtctcttctgctcctcctgagcagaaaaggggccgaggaaggcctcctaaagctaagcttaatggcctcactccaactcctgctcctgtgcttgctaatgggcaggcacagactggtcttggcttaaatgttggtgttactgctcagcctctctcggttgggtttcctattgaccccacctcctcgacggtgaagaaaggccgaggacggccgaagaaggtggcggtgactgaagctgggccgttagcggtgaacaaaggaaaagggaggccaccgaagactggacctttagggtccaagaagagtccaggaaggcccagaaagcctaagtctttggtggatgctaaaaagggccctggacgtccacctaagaatcagttaaagccagtgaccgttccttacgctgttgcagctcctactgctactgctattgctactgatgcagcagctatgtttaatgtgggatcaccaaggccccgaggcagacccaggaagggtgcagccctagcagctgctggtgttggtgctgtggtggtgcaggctaagcgaccaggccgcccacctaagctacctgtaattatgaagcctaaaccgaagaagagttcgggcaggcctgttggccggcctaggaagaatgcaaatgcaccatgggcaattaccagagcatctgagcctcaagcacaggcagaattacatggagatcttaagaggaaacttgaattttttcaatcaagagttaagcaagccattggggtgctaaagcctcacttgaccagtgccactatcagtgcagttgctgcagtccaagaattagaagggcttgcatcaatggacattaacgtaccatggagagaggaacctcaaccacaaattcaaccactgccgcagccactgccacaaatgcagccactgccgcaaattcagccactgctacagccacagccacagccccagccgcagccgcagccccagccccaaccgcaaccactgcagcaactgctccagagctag

SEQ ID NO: 388 - protein, 478 aa, Populus trichocarpa
MDPPPPSLLIHPPLPPSSPPPPTTAIPSTTETIPHLAPLPNPAPAVTQPSYAEMIYSAITALKEQDGSSRIAIAKYIERAYPGLPSNHSDLLTHHLKRLKNSGALVLNKKSYMLPRSDSNANITTTTPTVSTSPTQIQPQYAVPVSSAPPEQKRGRGRPPKAKLNGLTPTPAPVLANGQAQTGLGLNVGVTAQPLSVGFPIDPTSSTVKKGRGRPKKVAVTEAGPLAVNKGKGRPPKTGPLGSKKSPGRPRKPKSLVDAKKGPGRPPKNQLKPVTVPYAVAAPTATAIATDAAAMFNVGSPRPRGRPRKGAALAAAGVGAVVVQAKRPGRPPKLPVIMKPKPKKSSGRPVGRPRKNANAPWAITRASEPQAQAELHGDLKRKLEFFQSRVKQAIGVLKPHLTSATISAVAAIQELEGLASMDINVPWREEPQPQIQPLPQPLPQMQPLPQIQPLLQPQPQPQPQPQPQPQPLQQLLQS

SEQ ID NO: 389 - DNA, 1973 bp, Arabidopsis thaliana
ccgaaacaaaaaaaaaaaactaaaaatcaaaaatctcatcaccttccttgctctgtattttttctctctcactaaatcctccatggatccttctctctctgcaaccaatgatcctcatcatcctcctcctcctcagttcacatctttccctcctttcaccaacaccaaccccttcgcctctccaaaccaccccttcttcaccggacccaccgccgtcgcgccgccaaacaacatccatctctatcaagcagctcctccgcagcagccacaaacatctccagttcctcctcatccatctatttcccaccctccttactctgacatgatttgcacggcgattgcagcgttaaacgaaccagatgggtcaagcaagcaagctatttcgaggtacatagagagaatttacactgggattcctactgctcatggagctttgttgacacaccatctcaagactttgaagaccagtgggattcttgtcatggttaagaaatcttacaagcttgcttctactcctcctcctcctcctcctactagtgtagctcctagtcttgaacctcccagatctgatttcatagtcaacgagaaccaacctttacctgatccggttttggcttcttctactcctcagactattaaacgtggtcgtggtcgacctccaaaagctaaaccagatgttgttcaacctcaacctctgactaatggaaaactcacctgggaacagagtgaattacctgtctctcgaccagaggagatacagatacagccgccacagttaccgttacagccacagcagccggttaagagaccgccgggtcgtcctagaaaagatggaacttcgccgacggtgaagccagctgcttctgtttccggtggtgtggagactgtgaaacgaagaggtagacctccgagtggaagagctgctgggagggagagaaagcctatagtagtctcagctccagcttcagtgttcccgtatgttgctaatggtggtgttagacgccgagggagaccaaagagagttgacgctggtggtgcttcctctgttgctccaccaccaccaccaccaactaacgtagagagtggaggagaggaggttgcagtcaagaaacgaggaagaggacggcctcctaagattggaggtgttatcaggaagcctatgaagccgatgagaagctttgctcgtactggaaaacccgtaggaagacccagaaagaatgcggtgtcagtgggagcttctggacgacaagatggtgactatggagaactgaagaagaagtttgagttgtttcaagcgagagctaaggatattgtaattgtgttgaaatccgagataggaggaagtggaaatcaagcagtggttcaagccatacaggacctggaagggatagcagagacaacaaacgagccaaagcacatggaagaagtgcagctgccagacgaggaacaccttgaaaccgaaccagaagcagagggtcaaggacagacagaagcagaggcaatgcaagaagctctgttctaaagataaagccttgacataaaaagctagcaagtggtgggtttacttgttgtgtgttacatgaaatttttaatcttataagggtgtttgcaggagaaaaacaaaaagaacaatgtgatgaactgatgatgatgattgtgtctctaaccaaacaacaaggagaggtagggtaatgtctgtaaagtgaattaggatgttaccattgttcatgcttcccatctctctccatcgtccatatctgtgtaggcagctttgttctttgttccctcgtgttttttttagactgttgtgtctcttattctattttgtctccttaggctttttaggagttgttgttgatgtttatcaaaaacgcttatgtaatttttatgaccacttctactttttatgatggtttcttcaagtctcttacgttatgtagttagaaaaccattaaataaaagttgcttatgtc

SEQ ID NO: 390 - protein, 479 aa, Arabidopsis thaliana
MDPSLSATNDPHHPPPPQFTSFPPFTNTNPFASPNHPFFTGPTAVAPPNNIHLYQAAPPQQPQTSPVPPHPSISHPPYSDMICTAIAALNEPDGSSKQAISRYIERIYTGIPTAHGALLTHHLKTLKTSGILVMVKKSYKLASTPPPPPPTSVAPSLEPPRSDFIVNENQPLPDPVLASSTPQTIKRGRGRPPKAKPDVVQPQPLTNGKLTWEQSELPVSRPEEIQIQPPQLPLQPQQPVKRPPGRPRKDGTSPTVKPAASVSGGVETVKRRGRPPSGRAAGRERKPIVVSAPASVFPYVANGGVRRRGRPKRVDAGGASSVAPPPPPPTNVESGGEEVAVKKRGRGRPPKIGGVIRKPMKPMRSFARTGKPVGRPRKNAVSVGASGRQDGDYGELKKKFELFQARAKDIVIVLKSEIGGSGNQAVVQAIQDLEGIAETTNEPKHMEEVQLPDEEHLETEPEAEGQGQTEAEAMQEALF

SEQ ID NO: 391 - DNA, 1903 bp, Arabidopsis thaliana
acaaaaacaaaaaaatcaaaagagctctcagagcaaaaaacaaaaaaaaagaaaaaaaaaccctaaatctaaatctcaccttccacctctgtcttttttttttttgttcttttttttttttttactgtatcttctcttctctttgctctgcaaaaatctcacatccatggatccatctcttggtgatcctcatcatcctcctcagttcaccccttttcctcattttcccacctccaatcatcatcctttaggaccaaatccgtacaataaccatgtcgtcttccaaccgcagccgcaaacgcaaacgcaaatcccgcaaccgcagatgtttcagttatctccacatgtttcaatgccccaccctccttactccgaaatgatttgcgctgcgattgcggcgttaaacgaaccggatggttcgagcaagatggcaatttcgagatacatcgagagatgttacaccggtttaacttctgctcatgctgctttgttgactcaccatctcaagactttgaagaccagtggtgttctttctatggttaagaaatcttacaaaattgctggttcttctactcctcctgctagtgtagctgttgctgctgctgccgccgctcaaggtctcgatgttcccagatctgagattctccattcaagtaacaacgatcccatggcttctggctctgcttctcagcctctgaaacgaggtcgtggtcgtcctcctaagcctaaacctgaatctcaaccacaaccactacagcaacttccaccgaccaatcaagtccaggctaacggacagccaatctgggaacagcagcaagttcaatcacctgttccggttccgactccggttacagagtcggcgaagagaggacctggtcgtccaaggaagaacggttctgctgctcctgctactgcaccaatcgttcaagcttcggttatggctggaattatgaaacgtagaggtagaccaccgggtcgtcgagctgctgggagacagaggaagcccaaatccgtttcttctactgcctctgtgtatccttatgttgctaatggtgctagacgcagaggaaggcctaggagagttgttgaccctagcagtattgttagtgttgctccagtaggtggtgaaaatgtggcagcggttgcgccagggatgaagcgtggacgtggacgaccacctaagattggtggtgttatcagtaggcttattatgaagcctaagagaggacgaggacgtcctgtaggtagacccagaaagattggaacatcagtcacgactgggacacaagattctggagaactcaagaagaagtttgatatttttcaagagaaagtgaaagaaattgtgaaggtgttgaaggatggagttacaagtgagaatcaagcagtggtgcaagccataaaagatctggaagcactaacagtgacggagaccgttgagccacaagttatggaagaagtgcagccagaggagactgcagcaccacagactgaagctcaacaaactgaagctgctgagacacaaggaggacaagaagaaggacaagaaagagaaggagaaacacagacccagacagaagcagaggcaatgcaagaagctctgttctgaagaataataatgatctagaaaacaacctagacataatagccttggtgtttggcgttaggagtgtttttttttagttgttttaggtgttggaatcgcatcttaaattatataaaaatctataaggaattttaatttttctaggttttgttgtctgcagaagaagaaatagtagactcgttaatggtgttgttgtcggtgtgtctttaaccaaaccataagacgtggctgtaaattagcgatgtttctagtcttccatctttaataatctcttattgcgtctgtgcctttgttttt

SEQ ID NO: 392 - protein, 480 aa, Arabidopsis thaliana
MDPSLGDPHHPPQFTPFPHFPTSNHHPLGPNPYNNHVVFQPQPQTQTQIPQPQMFQLSPHVSMPHPPYSEMICAAIAALNEPDGSSKMAISRYIERCYTGLTSAHAALLTHHLKTLKTSGVLSMVKKSYKIAGSSTPPASVAVAAAAAAQGLDVPRSEILHSSNNDPMASGSASQPLKRGRGRPPKPKPESQPQPLQQLPPTNQVQANGQPIWEQQQVQSPVPVPTPVTESAKRGPGRPRKNGSAAPATAPIVQASVMAGIMKRRGRPPGRRAAGRQRKPKSVSSTASVYPYVANGARRRGRPRRVVDPSSIVSVAPVGGENVAAVAPGMKRGRGRPPKIGGVISRLIMKPKRGRGRPVGRPRKIGTSVTTGTQDSGELKKKFDIFQEKVKEIVKVLKDGVTSENQAVVQAIKDLEALTVTETVEPQVMEEVQPEETAAPQTEAQQTEAAETQGGQEEGQEREGETQTQTEAEAMQEALF

SEQ ID NO: 393 - DNA, 1685 bp, Brassica napus
aaacctaaaaactaaatctcacctgccgctgtcttttttttttttcttttttttccttcctttggtttcactgttcctgtctccaatggatccatccctttccagtgatcctcaccgttctcctcagtactctcctttccctcaatacccaacctccaacagccctttcgtctccgctccgaatctccccttttacggtgctcagccggttaaccaaactccgttcaacacccatgtctccccgccgcagccgcaaacgcaaacgctgacgcctccttctcagaccgctcctccttactctgaattgatcgtggaggcgattgcgcatttgaacgagcctgagggttcgagcaagatggcgatttcgaggtacatcgagagatctaaccctgttttgcccaccgatcaccaagctttgctggctcaccatctcaagaccttgaagaactgtggcgttctttctatggtcaagaagtcttacaagctcgctgcttcttcctctgctcccgagagcgtcgctgttgctgctgccgccgccgccgccggtctcgccgctcccagatctgagtctcctctggggaaccctggtcatctcgaccccgcctctggcgccgtttctggatccgcttctcagccgcagaagcgaggacgtggacgacctcctaagcctaagcctgaagcttcaccacaacaacagcaacaagtcgtcattgctcaacccaacgctgtccagcttaacgggcagccaagctgggagcaacctcagtttcctgtagccagtccgacccagacggttactgagtctgcaaagagagggcctggtcgtccaagaaaggacggatctgctccgatccctcgacctgctggtttgtctgtgatcatgaagcgaagaggcaggccaccgggtcgtagagctgctgggagacagaggaagcccttatcagtctcctctaccgcctctgtgtttccttacgtcgctaacggtgctagacgccgtggaaggccaaggagagttgactctggtggagtccccgttgctgctccagctggtggagaagctgtggccgctgcgccagggataaagcgtggacgaggaagaccacctaaggtcggtggtgttaagaataggctaatcaccaagcctaagcgtggacgaggacgtcccgttggtagacccagaaagaacccatggcccgtgacggtagctactggtgcactggagtctgcctatggagaactcaaggcaaagcttgacctctgtaatgagaaagcaaaagaaatcctgaatgtgttgaacgctggtattataaacaacgataatcaagcagctgtggaagcggcacaaaagctggaaggactaatttcaatgatggctgttgagccacaagctgtggaagaagcgcagccagaggaggcagcgccacagactgaagctgaagaaccacaaggagaaggagagggacatggacaagaaagagaaggagaagaagagcaagccccgacagaccagacccaggtgcagacagatgcagaggcaatgcaagaagctctgttctgaagaataattatctcgcaaaaaacagcctagacagtagccttggtgtttgtggtttaggagtgttctttttagtatttaggtactggatcctcctatctttaattaaaaacctataaggaattttagt

SEQ ID NO: 394 - protein, 490 aa, Brassica napus
MDPSLSSDPHRSPQYSPFPQYPTSNSPFVSAPNLPFYGAQPVNQTPFNTHVSPPQPQTQTLTPPSQTAPPYSELIVEAIAHLNEPEGSSKMAISRYIERSNPVLPTDHQALLAHHLKTLKNCGVLSMVKKSYKLAASSSAPESVAVAAAAAAAGLAAPRSESPLGNPGHLDPASGAVSGSASQPQKRGRGRPPKPKPEASPQQQQQVVIAQPNAVQLNGQPSWEQPQFPVASPTQTVTESAKRGPGRPRKDGSAPIPRPAGLSVIMKRRGRPPGRRAAGRQRKPLSVSSTASVFPYVANGARRRGRPRRVDSGGVPVAAPAGGEAVAAAPGIKRGRGRPPKVGGVKNRLITKPKRGRGRPVGRPRKNPWPVTVATGALESAYGELKAKLDLCNEKAKEILNVLNAGIINNDNQAAVEAAQKLEGLISMMAVEPQAVEEAQPEEAAPQTEAEEPQGEGEGHGQEREGEEEQAPTDQTQVQTDAEAMQEALF

SEQ ID NO: 395 - DNA, 2858 bp, Glycine max
ctctctgactcaattatattaagactctctctctccatctctttctcgatatataccgtaaatccaatccaattcccaattttcgaatctaccctttctctctctacgatggagccttcctcgatctctccaccgccagctccgcctgccaccgccgtccccttccccgccgaacccaacgaccaccttccaccacccattcccgaaccaccttctaaccacccaccctacgccgagatgatatacacggcaatcgaggcgctgaaggagaaagacggttctagcaagagggcaatagcgaagtatattgagcaagtgtatacgcagcttccaccgaatcactcagacttgttgactcagcacttgaatcacttgaagagtaggggattgctccaaatggtaaaaaaatcttacgcccttcctagatctgtgcccgtgtctgttcctggacctgcacccacacaagggacatcagcagtgccggctgctgttgttgccatcacgacgactccgaggcccagaggtcggcctcgcaaggcccaaaatccagttcagaactcgcctctgcctcaggacactgtcaacgtgcaggttcagcagaatgccgagccggtctgggctgcgcttgggcttgcagacgagcccgtgcaagcggaaggcagtggcaagaagcgaggtcgtccgaagaagagtggcatcttaggagcgggcctgaccaagaggggccgtcctcccggctctggaaaaaagccgggccgtcctcccaaggcaaccacaacagatgtttctgcttctgctgggcccaagagacgtccaggccgcccgcccaagaatcagtcgcagcccactctcattccctttgctccggctgtatctgccgcttccgtggatacagagcacgtggcagcatcagctgaaactgcgccggttgatgctgacgcggctctcggaccaagagcccgtggacggccgaagaaatatgctgacgagatgattgctgcgggccgaggcaggggacggggccgtgggcgcggtggcggcggaagaggacgagggagagggcgtggtgaattgcctgcacagcccagaaaaccaggggcaaggcccgtgggtcgtccgaaaaagggttcaacttctgctagtacttctcaaaatgctgcaaatgaagatctcaggaggaagcttgaacactttcaatcaaaagtcaaggaatctcttgcagtgcttaagcctcattttaaccatgaaagtccagtcactgcaattgctgctattcaagagctagaagtactgggaactatggacctcaatgtaccactaagggatgaaacacttccacatcaagtggagctgccaccaccacagccaccagtgcagcagcagcagcagccaccacagcagcagctgcagcagccaccccagcagccaccacagcaacacctagcaccacaacaactgccgccacagccaccgatatttcagcaaacatatcctccatttcatctgccgcagttccaccatcaccagccttcgctgcagttccagcaacagcagcagcagccgccacagccaccgccacagctattccagcaccaggcacagcctccttcccaccaacagtttcatccttaggaatcaggcccaggctaggaagaattacatggtcctcaatttgataatatgatgctaggaagaattacatggtcttcgatttggttatgaacaatctgaaacaagtgttttaacaaggcacatgaggggtaacatatttgtaaagcgagtaggcagtagcagaactgatttttcgtcaagtgaatcgattgtccatttagtttgttgttgtgcactattctagattgatccctgaagtaatttttagattttagagtactgataattctgttattgaagtaatatttgtttgactttggcagctttagattattagtcatattgttcatgttggtctaacacgttattgaatccgtttcctgttgctttccaatacccacgtctggttgctcggttagaccttccaccattaggatatttcctatctctgtgacagaaaaagaaccattgcctatctcccgttttcaatatagattgcccaggcaaatcctcgggatcccacttatacacatcggtttcatgaatcacgtcgagcttcagcctcttcccacaaatcttccgcttcagatagtacatcaccaactcctcatccgtgggatggaagcgaaaacccggcatcgacgacatcatctggctgaaacaatcagcggaaccagctcccgaagcctcacccattctcgatcgcaagaaaaaaatcaaacaacccttgatcacccaacacaaaaaacggaaacttttttaatcaaaacggaaaacccccaacacgattcgagcctccgagtattcgaaatcgccgatcgaatagagttaaaaaccctaactggggaaatcaaattaggggaaaaaaagaaaccaaaattattggaatcaagaagtggcaaagccgaaatcccacaactacatggtacgaatcgtacctctgggtgagaggattcgaaaggctgagtcgcggaacgaaaaaactagagcgagagagagagtcttgaaaggaaagaaacgcgtgaattgcgcgtgaattgggaaattggcgagggttttcctgcaaaatattacaagcctttagtcagtaatcaaacaagaacatattgaaggctagtcagagttttatttcagattaaagatcccttgccagtatatatgacagatcgatagagatgcacaccatatgctacatatataatatttgcctaaaagtagccagaactttagaactccaaagcattgac

SEQ ID NO: 396 - protein, 507 aa, Glycine max
MEPSSISPPPAPPATAVPFPAEPNDHLPPPIPEPPSNHPPYAEMIYTAIEALKEKDGSSKRAIAKYIEQVYTQLPPNHSDLLTQHLNHLKSRGLLQMVKKSYALPRSVPVSVPGPAPTQGTSAVPAAVVAITTTPRPRGRPRKAQNPVQNSPLPQDTVNVQVQQNAEPVWAALGLADEPVQAEGSGKKRGRPKKSGILGAGLTKRGRPPGSGKKPGRPPKATTTDVSASAGPKRRPGRPPKNQSQPTLIPFAPAVSAASVDTEHVAASAETAPVDADAALGPRARGRPKKYADEMIAAGRGRGRGRGRGGGGRGRGRGRGELPAQPRKPGARPVGRPKKGSTSASTSQNAANEDLRRKLEHFQSKVKESLAVLKPHFNHESPVTAIAAIQELEVLGTMDLNVPLRDETLPHQVELPPPQPPVQQQQQPPQQQLQQPPQQPPQQHLAPQQLPPQPPIFQQTYPPFHLPQFHHHQPSLQFQQQQQQPPQPPPQLFQHQAQPPSHQQFHP

SEQ ID NO: 397 - DNA, 922 bp, Gossypium arboretum
  misc_feature (866)..(866): n is a, c, g, or t
  misc_feature (868)..(868): n is a, c, g, or t
  misc_feature (909)..(909): n is a, c, g, or t
atacctaaaatggacccttttttctcttccatgcccgtagcccctcctcccccgatccctcccccgtccgtcatccccgtcgtccctccttttgtctctaaccctacgacggcgactacggtggctggtggtccaccaccgagtttcgatcacccatcttactctgacatgatatgcgaagctatcggggctttaaaagacaagaacgggtcaagcaaaagggctatagctaagtacatagagtcagctcacaaggacttgccaccaacacactcggccttgttgactcaccacttgaagcgcttgaaaaacaacggtatcttagtcatggtcaagaaatcttacaagcttgcttctactgctagatctgaggttcctatcccggattctactccttccaaccctcccgatgtttcttctcctcctggattcaaacgaagccgtggtcgtcctcctaaacccaaacccacaatttctgctcctgccgaccctattcctcagcagcagcagcagcagcagcaacagcaaccgctgcctgctccaattcccaatgacactaaaaggtctaaccggaggcccaggaagaatggtcccgttgctacactaggggataagaagggccaaggtcgtccacccaaaactggccctaagaagagtcccggtcgtcccaggaagcccaaaacggtcaggtcggtggtgggggctaatgcgatgaaaaggggtcgtgggcggccgcctaaggtcttgaaccagatgcctcaaccggctgttatgccgatccagggtcagcccatggctgttccttatgctgatactgctgctgctgttcctactactactgccgttgctgctggtccgaggcctanangaaggccaaaaggcactgcagtggctcctgctggccttgcngtcccctggaagg

SEQ ID NO: 398 - protein, 304 aa, Gossypium arboretum
  misc_feature (286)..(287): Xaa can be any naturally occurring amino acid
  misc_feature (300)..(300): Xaa can be any naturally occurring amino acid
MDPFFSSMPVAPPPPIPPPSVIPVVPPFVSNPTTATTVAGGPPPSFDHPSYSDMICEAIGALKDKNGSSKRAIAKYIESAHKDLPPTHSALLTHHLKRLKNNGILVMVKKSYKLASTARSEVPIPDSTPSNPPDVSSPPGFKRSRGRPPKPKPTISAPADPIPQQQQQQQQQQPLPAPIPNDTKRSNRRPRKNGPVATLGDKKGQGRPPKTGPKKSPGRPRKPKTVRSVVGANAMKRGRGRPPKVLNQMPQPAVMPIQGQPMAVPYADTAAAVPTTTAVAAGPRPXXRPKGTAVAPAGLXVPWK

SEQ ID NO: 399 - DNA, 815 bp, Allium cepa
gctagaaggaaaatagttatctccccaaattggaaaataaaagctggaaaccctagaaaatggcggccgtgtcagctcgtcctcctacggatccagtctcagccgaagctctcaaccatccttcttataaagagatgatagtggctgctataggatcactcaaggagaaaaatggttcaagtgaaccagctattgcggcctacatagcgtccaagtacaaagatctccctcctatccatgatgctctactctcccgccacttgagtgatctcaagaagcaaggaatcatcgaaacagttcactcctacaagcttgcaggcaaagcaggcgagaacactggcagcagtgcttccaagaagcgaggcagacccaagaaaaacctaagtcaagtaacaatgtcaagtccatcaagcgagaaacgtaaacggggcagaccacataaagcagcgtcaggaccaaccataatattgcctcaacacatgaaggcagttatgaaggcggataaaagaggatcagtggaatcaggtgggaaaagaataaggggtcgacctaagagattcatggacatggctgtgaaaagcagttcaggtaaaccaaaaagaaagcctggcaggcctatgaaaaccttagctctactggcggcttcagctgggaaaagaaaacggggtcgcccgaagtggggttctagtccattgtcgagccaaaaaaaagagaccaggtaggccctaaaaaaggatctgctgctactccaatgtttattgctggagtgcagctgaaaaccactccaggtaccagtggcacccctgcttcaggag

SEQ ID NO: 400 - protein, 220 aa, Allium cepa
MAAVSARPPTDPVSAEALNHPSYKEMIVAAIGSLKEKNGSSEPAIAAYIASKYKDLPPIHDALLSRHLSDLKKQGIIETVHSYKLAGKAGENTGSSASKKRGRPKKNLSQVTMSSPSSEKRKRGRPHKAASGPTIILPQHMKAVMKADKRGSVESGGKRIRGRPKRFMDMAVKSSSGKPKRKPGRPMKTLALLAASAGKRKRGRPKWGSSPLSSQKKETR

SEQ ID NO: 401 - DNA, 687 bp, Lotus japonica
atggactctatttgggtccctcctcctcctccgccaccaaccgccgttcccttcacccaggaagccatcaatcacgcaccagacagcaacatcccaattaactcctctgcccctgcgaatcatccaccttatgctgagatgatatacagagcaattgaggcgttgaaggagaaggatggatcaagcaaaacagcaattgccaagtacatcgaggaagcctacaccgaccttccacctgcacactccaccctcttgactcaccacctcaagcgcttgaaggacactggtctcctcatcatgctcaagaaatcttacaagctcccttcttctctcccttccgacatcactcagaatgctgctcagcctgtccggagaggacgccctcccagatctggaattcctaagaggcgcggccgccctcccaagcccaaatctctctccaacgggctcaagcgccgcccacccaagcaccaattgcaggccactgtcatcccgttcgctgatccttctctcgctcagccgcccgtgccagttggctctccgaggcccagaggccggcccaggaaaaatgcagctgcactgccgccgcctcatgcggttggaggtgtcgattcctccctgatggtgccaggccgtccccagaagcttgccgtcagaggcaggcccaagaatcctgccggaaggccc

SEQ ID NO: 402 - protein, 229 aa, Lotus japonica
MDSIWVPPPPPPPTAVPFTQEAINHAPDSNIPINSSAPANHPPYAEMIYRAIEALKEKDGSSKTAIAKYIEEAYTDLPPAHSTLLTHHLKRLKDTGLLIMLKKSYKLPSSLPSDITQNAAQPVRRGRPPRSGIPKRRGRPPKPKSLSNGLKRRPPKHQLQATVIPFADPSLAQPPVPVGSPRPRGRPRKNAAALPPPHAVGGVDSSLMVPGRPQKLAVRGRPKNPAGRP

SEQ ID NO: 403 - DNA, 1842 bp, Oryza sativa
cggaaatggtcgtcgccgtcgcctcaccttcgtcggcgccggggccgggcgccgccggccgcccccacccgacctacaaggagatgatcctgcgggcgctcaaggagcttccagatccgatcatctccagccgccgtgccatcgccaagtacatctccgacaacttctccggcctcccttctcaccacgacgcgctcctcaccgttcacctccgccgcctcaggtcacagggccttctcctcatgtctggacactcgtaccttctctccacctccgccaccgccgctcgaggacggggacgaggacgaccgcccaagaaagcttcctcctccgcgccgcctcaaaagcgcggacccggccgaccccgcaagaatacagccctgtttccggttcctgtgcttgaggcgaagcctgggcgcgggcgaccccggaagaaccctctccctgtggcttcctccacctcctctgctgctgctgctgctacggcgttgagcctgagagtgaagcggggacctgggaggccgcgcaagaatgctgctgctaccccgttgagactgggagtgaagcggggacctgggaggccgcgcaagaatgctgctgctaccccgttgagactgggagcgaagcggggacctgggagaccgcgcaagaatgccactgctacgccgttgagcctgggagttaagcggggacctgggaggccgcgcaagaatgctgctgctgctgcctctcccgttgctccgccgcctgcatctccactgaagcggggtgttggacgcccaaggaagaacgccactcctctagtcaagcctggacctgggaggccgtctggattcaaacgtggaccaggccgccctcgcaagaatgccactcctcctgtgctgtcagtgccacccactgctgctgctgtgttgggagtgaagcgtggccgtgggcgccctagaaaggataaaccattgcaatcttggtctgtgctctctggcggtgctgcaatgactaagagagggcctgggaggccaagaaagaagaggccactggaagctggaggtgttgtggcagcacaggtagacactgcagatggaggtgaggctggagccgttcaaaatggaggtgaagttaggtgtctgctctctgatggtgcttcttcaatggggaacagagggcctgggagtcctaggaaggaggtgctattggaaaatgaacctacagtttctacattggtgggaaagagaggccgtggccgtccaaaaaaggagaaaccatcagcagcaaggcctgctgaaactggagatgctaaatcaatggggatcaagagaggtcgcggaagaccaagaaaggacagttcctttcaagctgtgtttgcagaagctgcaggtcaggtgtcaagagatgtcacagcagctcagcccgaaggagatgcagatttactggcaaggaaggaaccagagactgcagctgtagtttcggtggagaacaaagaaactaggcctgcagatgctgggggtgttgtggtttctgaagagaagacatcgattgatccggtggaggctggaagtgtaatgccatgtgttaatgcagaagttgatcgcatgaactctgacctgcgcactgctaatccatagtgtggctggcgtcagcactcagcacagaagggaggacctggatggctggcactacctgcaggtgtgaatgtgtattcactgatttagctggagacatactgtgaaaactgttaaatgttgcaaccaaaattattactgtcatgctgttaagtagtttctcaagatcaacattggagtatgcttttaatgatatccacttctcggataaatttttataata

SEQ ID NO: 404 - protein, 538 aa, Oryza sativa
MVVAVASPSSAPGPGAAGRPHPTYKEMILRALKELPDPIISSRRAIAKYISDNFSGLPSHHDALLTVHLRRLRSQGLLLMSGHSYLLSTSATAARGRGRGRPPKKASSSAPPQKRGPGRPRKNTALFPVPVLEAKPGRGRPRKNPLPVASSTSSAAAAATALSLRVKRGPGRPRKNAAATPLRLGVKRGPGRPRKNAAATPLRLGAKRGPGRPRKNATATPLSLGVKRGPGRPRKNAAAAASPVAPPPASPLKRGVGRPRKNATPLVKPGPGRPSGFKRGPGRPRKNATPPVLSVPPTAAAVLGVKRGRGRPRKDKPLQSWSVLSGGAAMTKRGPGRPRKKRPLEAGGVVAAQVDTADGGEAGAVQNGGEVRCLLSDGASSMGNRGPGSPRKEVLLENEPTVSTLVGKRGRGRPKKEKPSAARPAETGDAKSMGIKRGRGRPRKDSSFQAVFAEAAGQVSRDVTAAQPEGDADLLARKEPETAAVVSVENKETRPADAGGVVVSEEKTSIDPVEAGSVMPCVNAEVDRMNSDLRTANP

SEQ ID NO: 405 - DNA, 1230 bp, Populus trichocarpa
gtcgtcgtttcaaaatcaattttttcacaatttctcccaaacacatactcaccctatctaatctccttttcaatttctcacccttaaacgctctctgtcttaaaaaaaattaaaatttccatggacccacctcctccttcattattgatccctccaccagttccgccgtccatccctccaccaccacccaccaccgaaacccccaccaccactgaaaccccccatttagctcctccacccaaccctacccccaccataacccatccttcctatgctgagatgatatattcagcgattacagctttgaaggaacaagatgggtcaagcaggatagccatagcaaagtatatagagagagcttaccctggtttatcaccgagtcactctgatttgttgacacatcacttaaaacgcttgaaaaatagtggggctcttgttctcaacaagaaatcttacttgttacccagatctgacattaacacagacatcagtgctactataactaccacagctactgtttctactaacccacctcaaattcagccacagtatgttgctcctatctcttcagctcctcctgagcagaaaaggggccgtggaaggccccctaaaactaaggctaatgggcttcctccaactcctgcgtctgtgcttgctaatgggcagccacagactggtcttggctcacatgtttctgttactgcccagactcaaagtcagcttgttgtgagttctgttgggactcctgttgactccacctcgacagggaggaaaggccgaggacggccaaagaagatggtggtgactgaagctgggccgttggtggtgaagaaaggaagagggaggccaccgaatagcgggccgttggggtccaagaagagtccaggaaggcccagaaagcctaagtctttggtgggtgctaaaaagggtcctggacgtccacctaagaatcagttaaagccagttactgttccttacgctgttgcttctcctactgctactgatgcagcagctgtgtttaatgtggcatcaccaaagcccagaggcaggccaaggaagggtgcagccccaactaatgctggcgctgttgtgatggtgcaggctaagccaccgggtcgcccggctaaggttcctggggttatgaagctgaagcctaagaagaattctggcaggcctgtcggccggcctaggaaggtaaatgttcttatctttacacgcattagggtatag

SEQ ID NO: 406 - protein, 369 aa, Populus trichocarpa
MDPPPPSLLIPPPVPPSIPPPPPTTETPTTTETPHLAPPPNPTPTITHPSYAEMIYSAITALKEQDGSSRIAIAKYIERAYPGLSPSHSDLLTHHLKRLKNSGALVLNKKSYLLPRSDINTDISATITTTATVSTNPPQIQPQYVAPISSAPPEQKRGRGRPPKTKANGLPPTPASVLANGQPQTGLGSHVSVTAQTQSQLVVSSVGTPVDSTSTGRKGRGRPKKMVVTEAGPLVVKKGRGRPPNSGPLGSKKSPGRPRKPKSLVGAKKGPGRPPKNQLKPVTVPYAVASPTATDAAAVFNVASPKPRGRPRKGAAPTNAGAVVMVQAKPPGRPAKVPGVMKLKPKKNSGRPVGRPRKVNVLIFTRIRV

SEQ ID NO: 407 - DNA, 1951 bp, Saccharum officinarum
cccaattccccaatttcctcaatcctcagttcagtagcataggggaaaaacaagagaggagaaacagcagcagcctagcggacgcaaggcgaaatggtggtcgccgtcgcgtcgccttcgtcggcggcaccggcaccctccgccggccgtctccatccgacatacaaggagatgatcatgcaggcgctgacggagctgcgggacccgggcgggtcgagccgcaccgccatcgccaactacatcgccgaccacttctccggcctccactctcgccacgacgccctcctctccgtccatctccgcagcctcaggtcccatggccaacttcgcctcgtctctggcaactacttcgtctccaccgccactcagcagcctgctccgggacagaagcgtggtcgggggcggcctcgcaagattccagatttagccccttccgcttcgattccggcgtttcagggccccaagcgagggcgtggacgcccacgcaagaacgccctagacccggtggcttcctctccttcgccgctacagggagcaagtgctccgccgcctccatctggggtcaagagggggcgtggacgcccgcggaaggacgcccttgtccctccgccttcctcttctttcgccactggccgggagcgattgatccaccgcctccatctggggtcaaagaggggccgtggacgccctcggaagagcgcccttgtccctgtgcgttcctccttttcacagctgctgggatctattgctccaccacttccgtctggggtcaaacgggggcgcggacgcccgcgcaagaatgcctaccccgcggtggcgccgttggtgggagttgagcagggacctgctggtggacaaccacagaggaataccactcctctctcacctccacctgctaccgtgccccacagtggtaagagtaagcctgtccggccgttcagggttgctgttgatgttagtgctttgcgtggttcctccatgaacatatctgcctgtagtaacagtgtggttggtgggaaagagaagatgcaacctgaatctgtgcagtccgcggatgcttcattgaagagagggcgtgggaggcccagaaaggagaaggcagtggaaagtagccacttgaaagccgcacagatgactgagggtcaacaggaagctctgactgcacaagctgcagaccaagctggggctgtgcaaaatgaagttgaagctggggacttgcaatccttgggtacttcttttacagagaagagaggccgcgggcgtcctagaaagaggccactggaaaccgaaactgcagaagcaggggttccttcatccacagtgaagagaggccgtgggagaccaagaaaggagaagacattggaaactggggaccccaaagttgcacagatgactgagggtcaacatgaagctctgcctgcacaagctgtagaccaaggtgggcctatgcaaaatgaagttgaagctaggattttgcaatcctttggtactcctttgatggagaagagaggtcgtgggcgacctaaaaagaggccattggaaactgaaactgcagaaacccaaggtgatgcattggtgaagaagcgagggcgtggcaggccaagaaaggccaggccttttgaaactgggtctgtggaaactgaagttcaggtgtctagggatttgaaaaaagataggcctgaaaaagatggggcatcttctgtcagggaaaaaagcaaaagctccaggtgtacttttggttgaggggataggcaatggccctgcagatgctggatgtttggtagtgtcaagggaggaggtaccaattgctccgatggatgctggaggtgtgctattatctgcagagggggcagccattgctcccatggatgctgggcgtgcaacaccaagggttggtccgatggatgtgggcaccaagagtcattagtgctctgatatttgcagcaacaac

SEQ ID NO: 408 - protein, 549 aa, Saccharum officinarum
MVVAVASPSSAAPAPSAGRLHPTYKEMIMQALTELRDPGGSSRTAIANYIADHFSGLHSRHDALLSVHLRSLRSHGQLRLVSGNYFVSTATQQPAPGQKRGRGRPRKIPDLAPSASIPAFQGPKRGRGRPRKNALDPVASSPSPLQGASAPPPPSGVKRGRGRPRKDALVPPPSSSFATGRERLIHRLHLGSKRGRGRPRKSALVPVRSSFSQLLGSIAPPLPSGVKRGRGRPRKNAYPAVAPLVGVEQGPAGGQPQRNTTPLSPPPATVPHSGKSKPVRPFRVAVDVSALRGSSMNISACSNSVVGGKEKMQPESVQSADASLKRGRGRPRKEKAVESSHLKAAQMTEGQQEALTAQAADQAGAVQNEVEAGDLQSLGTSFTEKRGRGRPRKRPLETETAEAGVPSSTVKRGRGRPRKEKTLETGDPKVAQMTEGQHEALPAQAVDQGGPMQNEVEARILQSFGTPLMEKRGRGRPKKRPLETETAETQGDALVKKRGRGRPRKARPFETGSVETEVQVSRDLKKDRPEKDGASSVREKSKSSRCTFG

SEQ ID NO: 409 - protein, 355 aa, Vitis vinifera
MDPAPPPPLPPPPPPQPPAASEAHVAHAANPTPSHGPPHNHPPYAEMITTAIGALNERTGSSKKAIAKYIERTFGDLPPSHPALLTHHLKRLRSSGQVVMVKHSYMLPRSGDDAHALPLHPGPVSGPKRGRGRPPKPKIPVQPTSESVLVAVGLVDGPVVPKRGPGRPPKSGGVRGPRPKSLDGPKRRPGRPPKAQLGGVIPGGVPRERPRTAGVTKVKVSGRPRGRPPKILTVGAGVGGGLSVKRRGRPPKADGPKRPKKLTGRPVGRPRKKLATGEILPAASEQPVAEWMNYEDLKQKLEHIQGKIKLSVGVLRTQFSENNVSAMSALQELEDLATMDISAPLNIEGQLFFGN

SEQ ID NO: 410 - protein, 63 aa, Artificial sequence
  H1 consensus sequence
HPPYAEMIAIAALKEDGSSKAIAKYIERYTGLPPHSALLTHHLKRLKSSGLLVMVKKSYKLAS

SEQ ID NO: 411 - protein, 50 aa, Artificial sequence
  MEME motif 1
  VARIANT (2)..(2): / replace = "Ser" / replace = "Lys"
  VARIANT (6)..(6): / replace = "Cys"
  VARIANT (10)..(10): / replace = "Gly" / replace = "Thr"
  VARIANT (13)..(13): / replace = "Asn"
  VARIANT (14)..(14): / replace = "Glu"
  VARIANT (15)..(15): / replace = "Lys"
  VARIANT (20)..(20): / replace = "Arg"
  VARIANT (24)..(24): / replace = "Ser"
  VARIANT (25)..(25): / replace = "Arg"
  VARIANT (31)..(31): / replace = "Phe"
  VARIANT (32)..(32): / replace = "Pro"
  VARIANT (33)..(33): / replace = "Glu"
  VARIANT (36)..(36): / replace = "Ser"
  VARIANT (39)..(39): / replace = "Glu"
  VARIANT (40)..(40): / replace = "Glu"
  VARIANT (48)..(48): / replace = "Thr"
  VARIANT (50)..(50): / replace = "Arg"
YAEMIYTAIAALKEPDGSSKRAIAKYIERAYTGLPPAHSALLTHHLKRLK

SEQ ID NO: 412 - protein, 15 aa, Artificial sequence
  MEME motif 2
  VARIANT (5)..(5): / replace = "Leu"
  VARIANT (8)..(8): / replace = "His"
  VARIANT (13)..(13): / replace = "Pro"
  VARIANT (14)..(14): / replace = "Ser"
GLLVMVKKSYKLARS

SEQ ID NO: 413 - protein, 17 aa, Artificial sequence
  MEME motif 3
  VARIANT (3)..(3): / replace = "Ser"
  VARIANT (4)..(4): / replace = "Gln" / replace = "Ser"
SAPPGQKRGRGRPPKPK

SEQ ID NO: 414 - DNA, 53 bp, Artificial sequence
  primer: prm11451
ggggacaagtttgtacaaaaaagcaggcttaaacaatggacccaccacctcct

SEQ ID NO: 415 - DNA, 50 bp, Artificial sequence
  primer: prm11452
ggggaccactttgtacaagaaagctgggtggaacaaattcatgatcctcg

SEQ ID NO: 416 - DNA, 2194 bp, Oryza sativa; identical to SEQ ID NO: 103

SEQ ID NO: 417 - DNA, 1440 bp, Populus trichocarpa
atggcttctacaatcacaggagttagtgttggtttaggactttcatgttctacaacaagaaagctgactcagaaaagaaatccttcatcatcaaggttgtctttttgcagcattaaaatggctgtctctgttgaagaagagaaaaagaagaagagtttcactcttgaaaaatctgaagaagctttcagcgctgctaaggaaatgatgccaggaggtgtgaattcacctgtacgtgcttttaaatctgttggtggacaacctattgtgcttgattctgtcaagggttctcacatgagggacattgatggaaatgattacattgattatgttggttcttgggggcctgctataattggtcatgcagatgatgaggtacttgcagccttgtctgaaacaatgaagaaagggaccagctttggtgccccttgtcttctagagaatgttttggcagagatggtgatcaaagcagttccaagcatagaaatggtacgatttgttaactcaggcacagaagcatgcatgggtgtgcttcgcctggcccgtgcctacactggacgggagaagattatcaagtttgagggctgttaccgtggccatgctgatccattccttgtcaaagcaggtagtggtgttgcaacccttgggctcccagactcgcctggtgtccccaaagcagcaacctatgaaactctaacagccccctataatgacattgctgctgtgggaaatctttttgagaacaacaaaggagagatttgtggaataatccttgaacctgttgtgggaaatgctggtttcatccccccgaaacctgaatttattaatgccattcgcaggatcactgaagaaaataacgctcttctaatatttgatgaagttatgactggattccgtttgtcatacggtggagctcaggagtattttggcataactcctgatttaacaacactagggaagatcattggtggtggtctgccagttggtgcatatggtgggagaagggagattatggagatggttgcacctgcagggccaatgtaccaggccggaaccttgagtgggaatcccttggctatgactgcagggatacacacactgaagcggttgcagaaaccaggaagttacgaatacttggataagattaccagtgaacttgttcagggcattattgatgctggcaagaaaactgggcatgcaatttgtggaggctatatacgtggaatgtttgggtttttctttacggaagggcctgtttacaactttgctgatgcaaagaaaagtgacacagcaaagttcgccagattttaccaaggaatgctgagggagggtgtatactttgcaccgtcacaatttgaagctgggtttacaagcttggcacatactgctgaagatatccaaaagacaatagcagcagccgaaaatgttctccggcagatttaa

SEQ ID NO: 418 - protein, 479 aa, Populus trichocarpa
MASTITGVSVGLGLSCSTTRKLTQKRNPSSSRLSFCSIKMAVSVEEEKKKKSFTLEKSEEAFSAAKEMMPGGVNSPVRAFKSVGGQPIVLDSVKGSHMRDIDGNDYIDYVGSWGPAIIGHADDEVLAALSETMKKGTSFGAPCLLENVLAEMVIKAVPSIEMVRFVNSGTEACMGVLRLARAYTGREKIIKFEGCYRGHADPFLVKAGSGVATLGLPDSPGVPKAATYETLTAPYNDIAAVGNLFENNKGEICGIILEPVVGNAGFIPPKPEFINAIRRITEENNALLIFDEVMTGFRLSYGGAQEYFGITPDLTTLGKIIGGGLPVGAYGGRREIMEMVAPAGPMYQAGTLSGNPLAMTAGIHTLKRLQKPGSYEYLDKITSELVQGIIDAGKKTGHAICGGYIRGMFGFFFTEGPVYNFADAKKSDTAKFARFYQGMLREGVYFAPSQFEAGFTSLAHTAEDIQKTIAAAENVLRQI

SEQ ID NO: 419 - DNA, 1419 bp, Arabidopsis thaliana
atggctgcgacgcttactggatcagggattgctctagggttttcgtgctccgcaaagttctctaagagagcttcttcgtcgtccaaccgtcgctgcatcaagatgtcggtttcggtagaggagaagacgaagaaattcactcttcagaaatctgaggaagctttcaatgctgcgaagaacttaatgcctggaggtgtgaactcacctgtacgtgctttcaaatctgttggtggacaaccagtggtgatggattctgcaaagggctcacgaataagagacattgatggaaatgaatacattgactatgttggatcttggggacctgctataattggtcatgctgatgatgaggttcttgctgctttggctgagacaatgaagaaaggaacaagctttggtgctccttgtctcttagagaatgttcttgctgagatggtgatttcagctgttccaagtattgaaatggttcggtttgttaactccggtacagaggcatgtatgggtgtgctacgtcttgctcgtgccttcacagggaaacaaaagttcatcaagtttgaaggttgttatcatggtcatgcaaactctttccttgtcaaagcaggtagtggtgtagctactttgggtctacctgactcgcctggggtccccaaagcagctacttcagatactttaacagctccatacaatgatattgctgctgttgagaagctttttgaggcaaacaaaggagagattgctgccatcattcttgaacctgttgttggtaactcgggttttattacacctaaaccagagttcattgagggaatacgccggatcactaaagacaatggtgctcttcttattttcgatgaagtcatgactggttttcgtttagcctatggtggagctcaagaatactttggaatcacacctgacttaacaactcttgggaaaatcatcggtggtggtcttcctgtgggagcatacggtggaagaagagacatcatggaaatggttgcacccgcaggaccgatgtatcaagctggtacgctaagtggtaatccgttggctatgacagcgggtatacacacgctgaagcggttaagtcagccagggacatatgaatacttagacaagatcacaaaagagcttacaaatgggatactagaagccgggaagaaaaccgggcatgcgatgtgtggcggttacataagcgggatgttcggtttcttcttcacggaaggacccgtctatgatttctcggatgcaaagaagagtgatacagagaagtttggaaagtttttcagaggaatgttggaagaaggtgtctacttggcaccttctcaattcgaggccggttttactagcttggctcacacttcagaagacatccaattcactatcgcagcggccgagaaggttctaagtcggctctaa

SEQ ID NO: 420 - protein, 472 aa, Arabidopsis thaliana
MAATLTGSGIALGFSCSAKFSKRASSSSNRRCIKMSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKFEGCYHGHANSFLVKAGSGVATLGLPDSPGVPKAATSDTLTAPYNDIAAVEKLFEANKGEIAAIILEPVVGNSGFITPKPEFIEGIRRITKDNGALLIFDEVMTGFRLAYGGAQEYFGITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 421 - DNA, 1425 bp, Arabidopsis thaliana
atgtcggcgacgcttacaggatcgggaactgctttggggttttcgtgttcctcgaagatctcgaaaagagtttcttcttcaccagcttctaaccgatgctgcatcaagatgtctgtttccgtcgacgagaagaagaaaagtttcagtcttcagaaatctgaggaagctttcaatgctgctaagaatctaatgcctggaggtgtgaattcccctgttcgagcattcaaatccgttggtggacaacctgttttgattgattctgttaaaggctcaaaaatgtgggacattgatggaaatgagtatattgactacgttggctcttggggacctgctattattggccatgctgatgacgaggttcttgcggctctagctgagacgatgaagaaaggaacaagctttggtgctccttgtctcttggagaatgttttagctgagatggttatatcagctgttcccagcattgaaatggttcggtttgttaattctggtactgaagcgtgtatgggtgtgcttcgtcttgccagagctttcactaacaaagagaagttcattaagtttgaagggtgttatcacggtcatgctaacgccttccttgttaaagctggtagtggtgttgccactttggggctaccggactctccaggtgtccctaaagcagctacttcagatactttaacagctccgtacaatgatcttgaagctgttgagaagctctttgctgcgcataaaggggagatttctgcggtaattctcgaacctgttgttggtaactccggattcatccctcctactccggaattcatcaacggtttacgccagcttactaaagacaatggtgttcttctcatcttcgatgaagtcatgactggatttcgtctagcctatggtggagcccaagaatactttggaatcacgcctgatctaactactcttggtaaaattattggtgggggtcttcccgtgggagcatacggtggtagacgtgatattatggagatggttgctcccgctggaccaatgtaccaagccgggactctaagtggtaatccgctggcaatgactgcagggattcacacgctgaagcggctaaagcaggcaggaacatatgagtatttagacaagatcacgaaggaactaaccaacggaatcttagaagccggaaagaaaaccgggcatccaatgtgcgggggttacataagcggtatgtttggattctttttcgcagaaggaccggtttacaactttgcagactcaaagaagagcgacacagagaagtttggtaggtttttcaggggaatgttggaagaaggtgtttactttgcaccgtctcagtttgaggccgggtttacgagcttggctcacactcccgaggatatacagttaacaattgctgcggctgagagggtactgagtaggatctag

SEQ ID NO: 422 - protein, 474 aa, Arabidopsis thaliana
MSATLTGSGTALGFSCSSKISKRVSSSPASNRCCIKMSVSVDEKKKSFSLQKSEEAFNAAKNLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDLEAVEKLFAAHKGEISAVILEPVVGNSGFIPPTPEFINGLRQLTKDNGVLLIFDEVMTGFRLAYGGAQEYFGITPDLTTLGKIIGGGLPVGAYGGRRDIMEMVAPAGPMYQAGTLSGNPLAMTAGIHTLKRLKQAGTYEYLDKITKELTNGILEAGKKTGHPMCGGYISGMFGFFFAEGPVYNFADSKKSDTEKFGRFFRGMLEEGVYFAPSQFEAGFTSLAHTPEDIQLTIAAAERVLSRI

SEQ ID NO: 423 - DNA, 1425 bp, Aquilegia sp.
atggcagcaatatcagcaggaacaggtattggtctttcatggagatcaaagccaatcacttattctaatccatcatcatcaagagttactcgtcgtttttcacaaataaaaatgacagcagtttcagtggagaagaagactctcaacattcctaaatccgaagaaatcttcaaagaagccaaggatttaatgcctggaggggttaattctccagtccgtgccttcaactcagttggtggacagcctattgtggtcgattctgtcaagggatctcacatgtgggacgtggatggcaatgagtacattgactatgttggttcctggggccctgcaatcattggtcatgcagatgataaggtacttgcagccttgactgagacgatgaagaaaggcactagctttggtgctccttctgctcttgagaatgtcttggcaaagatggtgatttctgctgtaccaagcattgagatggttcgatttgtcaactctggcacagaagcttgtatgggtgtgctccgtcttgctcgtgccttcaccggccggcaaaaaatcatcaaatttgaaggttgctaccatggccatgctgatccatttcttgtcaaggctgggagtggagttgcgacccttggcttacctgactctccaggggttcccaagtcatccactcatgatactctttcgtctccttacaatgacatatcaactgtggagaatctttttaaggcccacaaaggagagattgctgctgtgatccttgaaccagttgtcggtaactctggcttcattgaaccccaacctggttttttagatgctcttcgtcagattacgaaagaaaatgattctcttctcatctttgatgaggttatgactgggtttcgtttggcatatggtggagctcaagagtattttggtgtaacccctgatctgacaacactcggaaaaatcattggtggtggacttcctgttggagctttcggaggacgaagggagatcatggagatggtggctccagctggacccatgtaccaggctggaaccttgagtgggaacccattggcaatgacagctggcatccaaacgcttacaaggttgcaggagccaggtagttatgaatacttggataaaatcactggggaactcactaagggaattcttgatgctggaaagaaggctgggcacgagatgtgtggtggttacattaggggaatgtacggattcttcttcacaggaggaccagtttacaattttggggatgcaaagaagagtgacactgcaaaatttgcaaggttttactggggaatgttggaggaaggtgtctactttgcaccatcacagtttgaggctgggtttacaagcttagcacatacttctggtgatatccagcagacaatagaagccgctgagaaggttttccaacagctttaa

SEQ ID NO: 424 - protein, 474 aa, Aquilegia sp.
MAAISAGTGIGLSWRSKPITYSNPSSSRVTRRFSQIKMTAVSVEKKTLNIPKSEEIFKEAKDLMPGGVNSPVRAFNSVGGQPIVVDSVKGSHMWDVDGNEYIDYVGSWGPAIIGHADDKVLAALTETMKKGTSFGAPSALENVLAKMVISAVPSIEMVRFVNSGTEACMGVLRLARAFTGRQKIIKFEGCYHGHADPFLVKAGSGVATLGLPDSPGVPKSSTHDTLSSPYNDISTVENLFKAHKGEIAAVILEPVVGNSGFIEPQPGFLDALRQITKENDSLLIFDEVMTGFRLAYGGAQEYFGVTPDLTTLGKIIGGGLPVGAFGGRREIMEMVAPAGPMYQAGTLSGNPLAMTAGIQTLTRLQEPGSYEYLDKITGELTKGILDAGKKAGHEMCGGYIRGMYGFFFTGGPVYNFGDAKKSDTAKFARFYWGMLEEGVYFAPSQFEAGFTSLAHTSGDIQQTIEAAEKVFQQL

SEQ ID NO: 425 - DNA, 1422 bp, Brassica napus
atgtcggcgacgctaacgggatcgggaactgccttgggcttttcatgctcctcgaagatctcgaagagagtctcttcctctccgtctactcgctgcagcatcaagatgtcagtttccgtcgacgagaagaagaagagcttcacccttcagaagtccgaggaagctttcaatgccgccaagaatcttatgcctggaggtgtgaactcccctgttcgagccttcaaatccgttggtgggcaacccgttttgattgattcagttaaaggctcaaagatgtgggacatcgatggtaacgagtacattgactacgttggatcttggggaccagctatcatcggccacgctgacgacgaggttctcgcggctctagctgagaccatgaagaaaggaacaagctttggcgctccttgcctcttagagaatgttctagccgagatggttatctcagctgttcccagcattgagatggttcggtttgttaactccgggaccgaagcttgtatgggagtcctccgtctcgccagagccttcactaacaaagagaagttcatcaagttcgaaggttgttatcacggtcacgccaacgccttccttgtgaaagctggtagtggtgtagccactttaggactacctgactcgcctggtgtacctaaagcagctacttcagatactctaacggctccgtacaatgatattgaagctgttgcgaagctcttcgaggctcataaaggagagatctctgcggttattctcgaacctgttgttggtaactctggtttcatcactcctacgcctgagttcatcaatggtttaaggcagctgactaaagacaatggtgctcttctcatctttgatgaggtcatgactgggtttcgtttagcttatggtggagctcaggagtactttggaatcactcctgacttgactactcttgggaaaatcatcggtggtggtcttcccgtgggagcttacggtggaagacgagatattatggagatggttgctcctgcaggaccaatgtaccaggctgggacactaagtggtaacccgttggcaatgacggcagggattcacacgctgaagcggcttaagcagccagggacatacgagtatttagacaagatcaccaaggagctaaccaacgggatcttggaagcagggaagaaaacaggacatccaatgtgcggtggttacataagtggtatgttcggtttctttttcgctgaaggtccggtgtacaactttgctgacgccaagaagagcgatacggagaagtttggtaagtttttcagaggaatgttggaggaaggtgtttactttgcaccgtctcagttcgaggctgggtttactagcttggctcacacttccgaggatatacagttcaccatttctgcggccgagagggtcctcggaaggatctag

SEQ ID NO: 426 - protein, 473 aa, Brassica napus
MSATLTGSGTALGFSCSSKISKRVSSSPSTRCSIKMSVSVDEKKKSFTLQKSEEAFNAAKNLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDIEAVAKLFEAHKGEISAVILEPVVGNSGFITPTPEFINGLRQLTKDNGALLIFDEVMTGFRLAYGGAQEYFGITPDLTTLGKIIGGGLPVGAYGGRRDIMEMVAPAGPMYQAGTLSGNPLAMTAGIHTLKRLKQPGTYEYLDKITKELTNGILEAGKKTGHPMCGGYISGMFGFFFAEGPVYNFADAKKSDTEKFGKFFRGMLEEGVYFAPSQFEAGFTSLAHTSEDIQFTISAAERVLGRI

SEQ ID NO: 427 - DNA, 1422 bp, Brassica napus
atgtcggcgacgcttacaggatcaggaaccgctttgggcttctcatgctcctcgaagatccctaagagagtctctccttcctcttctaaccgatgctccatcaaaatgtcagtctccgtcgacgagaagaagaaaagcttcactcttcagaagtccgaagaagctttcaacgcagccaaggatctgatgcctggaggtgtgaactcccctgtccgagccttcaaatccgttggcggacaacctgttctgattgattccgttaaaggctcaaagatgtgggacattgatggtaatgagtacattgactatgtcggatcttggggaccagctataatcggccatgctgatgatgaggttcttgcggctttagctgagacgatgaagaaaggaacaagctttggtgctccttgtctcttagagaacgttctagcggagatggttatatcagctgttcccagcattgagatggttcggttcgttaactccggaaccgaagcttgtatgggtgtgcttcgtctcgccagagccttcaccaacaaagagaagttcatcaagtttgaagggtgttatcacggtcacgccaacgccttccttgttaaagctggtagtggtgtagccactttaggactacctgactcgcctggtgttcctaaagcagctacttcggatactttgaccgctccttacaatgatattgaagctgttgcgaagctctttgaggctcataaaggggagatctctgcggttattcttgagcctgttgttggtaactcgggtttcatcactcctacgcttgagttcatcaatggtttgcgtcagctgagtagagataatggtgcacttctcatctttgatgaggttatgactggttttcgtttagcttatggtggtgctcaggagtactttggtatcactcctgacttgactactcttgggaaaatcatcggtggcggtcttcctgtgggagcttatggtggaagacgagatattatggagatggttgcacctgcaggaccaatgtaccaagccgggacactaagtggtaacccactggcaatgaccgcaggtattcatacactaaagcggctgaagcagccaggaacatacgagtacttagacaagatcaccaaggaactaaccaacggcatcttagaagccgggaagaaaaccggacatgcaatgtgcggcggttacataagcggtatgttcggtttctttttcacagaaggaccggtctacaacttcgcagatgccaagaagagcgacacggagaagtttggtaggttcttcaggggaatgttggaagaaggtgtttactttgcaccctctcagtttgaagctgggtttactagcttggctcacactacagaggatgtacagttcactattgcggcggctgagagggttcttggtaggatctag

SEQ ID NO: 428 - protein, 473 aa, Brassica napus
MSATLTGSGTALGFSCSSKIPKRVSPSSSNRCSIKMSVSVDEKKKSFTLQKSEEAFNAAKDLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDIEAVAKLFEAHKGEISAVILEPVVGNSGFITPTLEFINGLRQLSRDNGALLIFDEVMTGFRLAYGGAQEYFGITPDLTTLGKIIGGGLPVGAYGGRRDIMEMVAPAGPMYQAGTLSGNPLAMTAGIHTLKRLKQPGTYEYLDKITKELTNGILEAGKKTGHAMCGGYISGMFGFFFTEGPVYNFADAKKSDTEKFGRFFRGMLEEGVYFAPSQFEAGFTSLAHTTEDVQFTIAAAERVLGRI

SEQ ID NO: 429 - DNA, 1392 bp, Chlamydomonas reinhardtii
atgcagatgcagctgaacgccaagaccgtgcagggcgccttcaaggcgcagcgccctcgctctgtccgcggcaacgtggcggtgcgcgcagtggccgctccccctaagctggtcaccaagcgctccgaggagatcttcaaggaggctcaggagctgctgcccggtggcgtgaactcgcccgtgcgcgctttccgctcggttggtggcggccccatcgtcttcgacagggtcaagggtgcctactgctgggacgtcgatggcaacaagtacatcgactacgttggctcttggggccctgccatttgcggccacggcaacgacgaggtcaacaacgccctgaaggcgcagatcgacaagggcacctcgttcggtgctccctgcgagctggagaacgtgctggccaagatggtgattgaccgcgtgccctcggtggagatggtgcgcttcgtgtcctcgggcactgaggcgtgcctgtcggtgctgcgcctgatgcgcgcatacaccggccgcgagaaggtgctgaagttcaccggctgctaccacggccacgccgactccttcctggtgaaggccggctccggtgtgatcaccctgggcctgcccgactcgcccggtgtgcccaagagcaccgccgccgccaccctgaccgccacctacaacaacctggactccgtgcgcgagctgttcgccgccaacaagggcgagattgccggtgtgatcctggagcccgtggtcggcaacagcggcttcattgtgcccaccaaggagttcctgcagggcctgcgcgagatctgcacggctgagggcgccgtgctgtgcttcgatgaggtcatgaccggcttccgcattgccaagggctgcgcccaggagcacttcggtatcacccccgacctgaccaccatgggcaaggtcattggtggcggcatgcctgtgggcgcctacggcggcaagaaggagatcatgaagatggtcgcccccgccggccccatgtaccaggccggcaccctttcgggcaaccccatggccatgactgccggcatcaagacgctggagatcctgggccgccccggcgcctacgagcacctggagaaggtgaccaagcgcctgatcgacggcatcatggccgccgccaaggagcacagccacgagatcaccggcggcaacatcagcggcatgtttggcttcttcttctgcaagggccctgtgacctgcttcgaggacgccctggcggccgacactgccaagttcgcgcgcttccaccgcggcatgctggaggagggcgtctacctggctccctcgcagttcgaggccggcttcacctctctggcccactccgaggcggacgtggatgccacgatcgccgccgctcgccgcgtgttcgcccgcatctaa

SEQ ID NO: 430 - protein, 463 aa, Chlamydomonas reinhardtii
MQMQLNAKTVQGAFKAQRPRSVRGNVAVRAVAAPPKLVTKRSEEIFKEAQELLPGGVNSPVRAFRSVGGGPIVFDRVKGAYCWDVDGNKYIDYVGSWGPAICGHGNDEVNNALKAQIDKGTSFGAPCELENVLAKMVIDRVPSVEMVRFVSSGTEACLSVLRLMRAYTGREKVLKFTGCYHGHADSFLVKAGSGVITLGLPDSPGVPKSTAAATLTATYNNLDSVRELFAANKGEIAGVILEPVVGNSGFIVPTKEFLQGLREICTAEGAVLCFDEVMTGFRIAKGCAQEHFGITPDLTTMGKVIGGGMPVGAYGGKKEIMKMVAPAGPMYQAGTLSGNPMAMTAGIKTLEILGRPGAYEHLEKVTKRLIDGIMAAAKEHSHEITGGNISGMFGFFFCKGPVTCFEDALAADTAKFARFHRGMLEEGVYLAPSQFEAGFTSLAHSEADVDATIAAARRVFARI

SEQ ID NO: 431 - DNA, 1407 bp, Chlorella vulgaris
atggtagcgacccacatgcacacaaggctcgacagagcatttgcacagccatcagccgccctcccctgccgccgcacctctgtcaggacaatggctgccattgcagcgcctcccaagactaagctcaacacacagaagtctgaggagatctttgcagaggcccagacgctgctgccgggaggagtcaactcgccggtgcgtgcgttcaagtctgtgggcggccagcccatcatctttgagagcgtcaacggcccctactgctttgatgtggacggtaacaagtacatcgactatgtgggcagctggggtcctgccatcgtgggccatgcgcacccagaggtcacagcggctctggccgagcagatcaagaagggcacgtcgtacggcgccccctgcgcgctagagaacgtgctggccaaggtggtgatcgaccgcgttccctccattgagatggtccgctttgtcaacagcggcactgaggcctgcctctccgtgctgcgcctcatgcgcgccttcaccggccgtgacaaggtgctcaagtttgtgggctgctaccacggccacgcagacagcttcctggtgcaggctggctctggtgttgccaccctgggcctcccagactccccaggagtgcctgcttcctccacagccaccacgctgacggcggagtacaatgacttggaggccgtgcgcgcggtctttgaggccaacaagaacgagctggcgggtgtcatcctggagcctgtagtgggcaactccgggttcatccctcccacacaggagttcctggagggcctgcggtcgctgtgcacggagcacggcacgctgctgtgctttgacgaggtcatgaccggcttccgcatcgccaagggctgcgcgcaggcgcacttcaacatcatgcccgacctcaccaccctgggcaaggtgattggaggtggactccctgtgggcgcatatggaggccgcaaggagatcatgcagatggtggcacctgcaggtcccatgtaccaggcaggcacactgtcaggcaacccgctcgccatggtggccggtatcaagaccctggagatcctagacaggccaggggcctacgagcatctggacgctgtcactggcaagctcatccagggcctgctgcaagccgggcgcgaggctggccacgacatgtgcggcggccacatcagcggcatgttcggcttcttctttaacaagggcccagtgaacaactttgaggacgccaagcagtcggacacggccaagtttggccgcttccaccgcggcatgctcgagcacggcatctacctcgctccctccgcatacgaggctggcttcacatcactggcccacactgacgaggacattgaggccaccatccaggcagcacgcgaggtctttgccgagatctag

SEQ ID NO: 432 - protein, 468 aa, Chlorella vulgaris
MVATHMHTRLDRAFAQPSAALPCRRTSVRTMAAIAAPPKTKLNTQKSEEIFAEAQTLLPGGVNSPVRAFKSVGGQPIIFESVNGPYCFDVDGNKYIDYVGSWGPAIVGHAHPEVTAALAEQIKKGTSYGAPCALENVLAKVVIDRVPSIEMVRFVNSGTEACLSVLRLMRAFTGRDKVLKFVGCYHGHADSFLVQAGSGVATLGLPDSPGVPASSTATTLTAEYNDLEAVRAVFEANKNELAGVILEPVVGNSGFIPPTQEFLEGLRSLCTEHGTLLCFDEVMTGFRIAKGCAQAHFNIMPDLTTLGKVIGGGLPVGAYGGRKEIMQMVAPAGPMYQAGTLSGNPLAMVAGIKTLEILDRPGAYEHLDAVTGKLIQGLLQAGREAGHDMCGGHISGMFGFFFNKGPVNNFEDAKQSDTAKFGRFHRGMLEHGIYLAPSAYEAGFTSLAHTDEDIEATIQAAREVFAEI

SEQ ID NO: 433 - DNA, 1380 bp, Chlorella sp.
atgcaggccgccaggccccagacgcaggcggccgcgacacggtgccgcaaggccaccattgtgcgctccacggcggcccccgccaccgctaccaagctcaacaccaagcgctccgaggagatcttcaaggaggcgcaggagctgcttcccggtggtgtcaactcgcctgtccgtgccttcaagagcgtgggcggccagcccatcgtgtttgaccatgtcaagggcgcctactgctgggatgctgacaacaacaagtacattgactacgtcggctcctggggcccggccattgtgggccatgccaacgacgaggtgaacgaggcgctcaaggcgcagatcgagaagggcacgtcctttggcgcgccctgcgagctggagaatgtgctggccaagatggtgattgagcgggtaccatctgtggagatggtgcgctttgtcaactcgggcaccgaggcctgcctgtcggtggtgcgcctcatgcgcgcttacacgggccgtgagaagatcatcaagttcactggctgctaccacggccatgccgaccagttcctggtgcaggcaggcagcggcgtgctgacgctgggcctgtctgactctcccggcgtgcccgccaccactgctgctgccacgctcactgcccagtacaacgacatcgagtcggtcaaggcgctgtttgaggccaacaaaggcgagattgcgggcctcatcctggagccggttgtgggcaactccggcttcatcccacccaccaaggagttcctgcagggcttgcgtgacgtctgcaccaaggagggtgcggtgctgtgctttgacgaggtgatgactggtttccgcattgccaagggctgcgcccaggaatactttggcatcacccccgatgtcactaccatgggcaaggtcatcggcggcggcctgcctgtgggtgcctatggcggcaagaaggagctcatgcagatggtggcgcccgcgggccccatgtaccaggcgggcaccctaagcggcaaccctctggccatggtggcaggcatcaagacgctggagatcctggcccgccctggcgcctatgagcacctggacaaggtgaccaagaggctcatcagcggcatcctggatgccgccaaagagacggggcacgcaatgtgcggtggaagcatcagcggcatgtttggcttcttcttctgcgagggccccgtgtcgtcctttgaggatgccaaggcgtcggacaccgccaagtttggcaagttccatcgcggcatgctggagcagggcgtgtacctggcgccatcgcagttcgaggcggggttcacctcgctggcccacactgaggaggacattgaccgcaccattgaggctgcccgcaccgtgctcaagagcctctga

SEQ ID NO: 434 - protein, 459 aa, Chlorella sp.
MQAARPQTQAAATRCRKATIVRSTAAPATATKLNTKRSEEIFKEAQELLPGGVNSPVRAFKSVGGQPIVFDHVKGAYCWDADNNKYIDYVGSWGPAIVGHANDEVNEALKAQIEKGTSFGAPCELENVLAKMVIERVPSVEMVRFVNSGTEACLSVVRLMRAYTGREKIIKFTGCYHGHADQFLVQAGSGVLTLGLSDSPGVPATTAAATLTAQYNDIESVKALFEANKGEIAGLILEPVVGNSGFIPPTKEFLQGLRDVCTKEGAVLCFDEVMTGFRIAKGCAQEYFGITPDVTTMGKVIGGGLPVGAYGGKKELMQMVAPAGPMYQAGTLSGNPLAMVAGIKTLEILARPGAYEHLDKVTKRLISGILDAAKETGHAMCGGSISGMFGFFFCEGPVSSFEDAKASDTAKFGKFHRGMLEQGVYLAPSQFEAGFTSLAHTEEDIDRTIEAARTVLKSL

SEQ ID NO: 435 - DNA, 1380 bp, Emiliania huxleyi
atgctgagcctcgcctccttctcgctcggcctgaacctgggcgccaccccgacgcgcgctggcgatgtccgcatggcggtcgacgtgcgcgcgccgttcaagacgaccgagtctgaccggcttatggacgaggcgcgcgagatcatgccgggcggcgtctcctcgcccgtgcgcgccttcaagtcggtcggcggcgacccggtcgtgtttgaccgggtcaagggtgcgtacgcgtgggacgtggacggcaacaagtacgtcgactacgtcggaacgtggggccccgccatcgtcggtcacgccgacgaccgcgtcctcgacgccgtcaaggcgacgatggacaagggcacgtcgttcggcgcgccgtgcgcgctcgagaatgagcttgcaaagatggtcatcgacgcggtgccgtcggtcgagatggtgcgcttcaccaactcggggacggaggcctgcatgggcgtcctccgcctcatgcgcgcctacaccaagcgcgagaaggtgatcaagtttgacgggtgctaccacgggcatgcagactcgttcctcgtcgccgccggctcgggcgtcgcgacgctcgggctgcccgactcgccgggcgtgacgcagggcgcgtcggcgtcgacgctggtggcgacgtacaacgacatcgagtcggtcaaggccctcttcgaggccaacaagggggaggtcgccggtgtgattctcgagggcgtcgttggcaactctggcttcatcgttccggaccaggccttcctgacggagctgcggcaggtgtgcgacgacaacggggcggtgctcgtgtttgacgaggtgatgacgggcttccgcatctcgtacggcggcgcgcagcagcactggggcatcaccccggacctctccaccttcggcaaggtgattggcgggggcttgcctgtcggcgcgtacgcgggcaagaaggagatcatggagatggttgcgccggcggggccgatgtaccaggccggcaccctctcgggcaacccgctggcgatgactgcgggcatcgagacgatgaagatcctcaagcagcccggcacgtacgagcagctcgaccgcatgacggacaagctcatcaacggcatcctcgacgccggtaaggctgccggccacgccgtgtgcggaggccacatctccggcatgttcggcttctttttcaccgacgggcccgtcaagtgctttgcggacgcggcgaagagcgacaccgccaagttcgcaaagtggcaccgcggcatgctcgagcgcggtgtgtacctcgcgccgtcgcagtacgaggcgggcttcatgtcgctctcccactccgaggccgacatcgagcacacgattgcgatggccaaggaggtgtttgctgagctgtga

SEQ ID NO: 436 - protein, 459 aa, Emiliania huxleyi
MLSLASFSLGLNLGATPTRAGDVRMAVDVRAPFKTTESDRLMDEAREIMPGGVSSPVRAFKSVGGDPVVFDRVKGAYAWDVDGNKYVDYVGTWGPAIVGHADDRVLDAVKATMDKGTSFGAPCALENELAKMVIDAVPSVEMVRFTNSGTEACMGVLRLMRAYTKREKVIKFDGCYHGHADSFLVAAGSGVATLGLPDSPGVTQGASASTLVATYNDIESVKALFEANKGEVAGVILEGVVGNSGFIVPDQAFLTELRQVCDDNGAVLVFDEVMTGFRISYGGAQQHWGITPDLSTFGKVIGGGLPVGAYAGKKEIMEMVAPAGPMYQAGTLSGNPLAMTAGIETMKILKQPGTYEQLDRMTDKLINGILDAGKAAGHAVCGGHISGMFGFFFTDGPVKCFADAAKSDTAKFAKWHRGMLERGVYLAPSQYEAGFMSLSHSEADIEHTIAMAKEVFAEL

SEQ ID NO: 437 - DNA, 1422 bp, Festuca arundinacea
atggccggagcagcagctgccgccgccgccgccgtggcctcggggatctcgatccggacggtgtctgcgcccaaggcctcgcgcgcgccccgcgctcggtcggtggtgcgggccgccatctccgtcggagagaaggcctacacggtccacaagtccgaggagatcttcaacgccgccaaggaactcatgcctggaggtgttaattctccagtccgtgccttcaagtcagttggcgggcagcccatagttttcgattcggtgaaaggttctcacatgtgggatgttgatgggaatgaatacattgactatgttggttcatggggtcctgcgatcattggtcacgcagatgatacggtgaatgctgcactaattgaaactctgaagaagggaactagctttggtgctccatgtgcgttggagaatgtgttggctcagatggttatctcagctgtccccagtattgagatggtccgttttgtaaattctggaacagaagcctgcatgggagcactccgccttgtacgtgcattcaccgggagggaaaagattctgaagttcgaaggctgttaccatggccatgctgattcattccttgttaaagctggcagtggtgttgccacccttggcctcccagattcccctggagttcccaagggagctaccgttgggactctaacagcaccatataatgatgcggaggctgtaaaaaagctgtttgaggataacaaaggggagattgctgcagtcttccttgagccggttgtcggcaatgctggcttcattcctccaacacctgctttcctaaatgctctccgtgaggttaccaaacaagacggtgcacttctggtctttgatgaagtgatgactggttttcgtttagcatatggtggagctcaagagtattttggaatcacccctgatgtgacaacgttggggaaaattattggtggtggtcttccagttggtgcttacggtgggcggaaggacatcatggagatggttgctccagcagggccgatgtaccaggcaggaaccctcagtggaaaccctctagctatgactgctggaatccacacgctcaagcgtctgatggagcctggcacctatgaatacttagacaaggtcactggtgaacttgtccagggtatattggatgctggcgctaaaacagggcatgagatgtgtggaggacacatcagaggaatgttcggattcttcttcgcgagtggcccagtttacaactttgatgatgccaagaagagcgacactgccaagtttgggaggtttcaccgtggaatgctggaagaaggtgtatatctagcgccatcccagttcgaggcaggctttaccagcttggctcacaccccccaggatatcgagaaaactgtggaggctgcagagaaagttcttagacggatatag

SEQ ID NO: 438 - protein, 473 aa, Festuca arundinacea
MAGAAAAAAAAVASGISIRTVSAPKASRAPRARSVVRAAISVGEKAYTVHKSEEIFNAAKELMPGGVNSPVRAFKSVGGQPIVFDSVKGSHMWDVDGNEYIDYVGSWGPAIIGHADDTVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDAEAVKKLFEDNKGEIAAVFLEPVVGNAGFIPPTPAFLNALREVTKQDGALLVFDEVMTGFRLAYGGAQEYFGITPDVTTLGKIIGGGLPVGAYGGRKDIMEMVAPAGPMYQAGTLSGNPLAMTAGIHTLKRLMEPGTYEYLDKVTGELVQGILDAGAKTGHEMCGGHIRGMFGFFFASGPVYNFDDAKKSDTAKFGRFHRGMLEEGVYLAPSQFEAGFTSLAHTPQDIEKTVEAAEKVLRRI

SEQ ID NO: 439 - DNA, 1422 bp, Fragaria vesca
atggccaacacgatcgctggcgtcgccgtcgggatttcatccgcaactcccaggctttctcagagacccatttcacgatcttctcggcgtttctccaccgtcaaaatggccgtctccctcgaccagaagaagaagaatttcactcttcagaaatccgaggaggccttcaatgccgccaaggagttgatgcctggaggtgtgaattcccctgtacgtgcatttaaatctgttggtggacaacctattgtgatcgattctgtcaagggatctcatatgtgggacattgatggtaatgagtacattgactatgtaggttcttggggacctgcaattatcgggcacgctgatgataaggtacttgcagctctggctgaaacaatgaagaaaggaacaagctttggcgctccttgtcttctagaaaatgttctggcaaaaatggtgattgaagctgttccgagcattgaaatggttcgatttgttaactctggcacagaagcatgtatgggtgtgcttcgtctggcccgtgcatatactggccgagggaagataattaagtttgagggctgttaccatggccatgctgatccattccttgtaaaggctggtagtggtgttgccacattgggacttccagactcaccaggtgttcctaaagcagcgaccagcgatactctaacagccccatacaatgatttgtgcgccgtggaagctctctttcaaagtaacaaaggagaagttgcagcaatcatccttgaaccagttgttgggaactctggttttatcactccaaccccagatttccttaacggaatacgtaaactcaccaaagaacatggtgctctcctcatttttgatgaggtgatgactgggttccgtttgtcttatggtggagctcaggagtattttggcattactcccgatttaacaacacttggaaagatcattggtggcggtctgccagttggtgcatatggtggaaggagggagattatggaaatggtggcaccagcagggccaatgtatcaggctggaaccttgagtggtaacccgctagcaatgactgctgggattcacactctcgagaggttgaagcagcccggcagctacgaacacctgaacaagattacaagtgaccttattcaaggtattatagatgccggtaagaaggctgggcatgcaatttgtggtgggtatatcagtgggatgtttggattcttctttactgaagggcctgtctacaactttgacgatgcaaaaaagagtgacactgcaaagtttggaaggttctataggggaatgctggaggaaggtgtgtactttgctccctcacagtttgaggctgggtttacaagcttggcgcatactcctgaggacatccaaaatacgatagccgctgcagagaaagtttttaggcagatatag

SEQ ID NO: 440 - protein, 473 aa, Fragaria vesca
MANTIAGVAVGISSATPRLSQRPISRSSRRFSTVKMAVSLDQKKKNFTLQKSEEAFNAAKELMPGGVNSPVRAFKSVGGQPIVIDSVKGSHMWDIDGNEYIDYVGSWGPAIIGHADDKVLAALAETMKKGTSFGAPCLLENVLAKMVIEAVPSIEMVRFVNSGTEACMGVLRLARAYTGRGKIIKFEGCYHGHADPFLVKAGSGVATLGLPDSPGVPKAATSDTLTAPYNDLCAVEALFQSNKGEVAAIILEPVVGNSGFITPTPDFLNGIRKLTKEHGALLIFDEVMTGFRLSYGGAQEYFGITPDLTTLGKIIGGGLPVGAYGGRREIMEMVAPAGPMYQAGTLSGNPLAMTAGIHTLERLKQPGSYEHLNKITSDLIQGIIDAGKKAGHAICGGYISGMFGFFFTEGPVYNFDDAKKSDTAKFGRFYRGMLEEGVYFAPSQFEAGFTSLAHTPEDIQNTIAAAEKVFRQI

SEQ ID NO: 441 - DNA, 1413 bp, Glycine max
atggctgtttcggctatcacaggagcgaggctaaccctagggatagggttggcgatacctctttcctctcccacgcgctctcgaaccgtcgcaatggccgtatccgtcgaccccaagaccgacaacaaactcactcttaccaagtccgaggaagctttcgctgctgccaaggagctgatgcctggaggtgtcaactccccagttcgtgccttcaaatccgtgggtggtcaaccaattgtgattgattcagtcaaagggtctcgtatgtgggacatcgacggcaatgagtacattgactacgtcggttcttggggtcccgcaatcattggtcacgctgatgatcaagtgctttcagctctggttgaaaccatgaagaaaggaactagctttggtgcaccctgtctgctggaaaacactttggcagagctggttatcaatgcggtccccagcattgaaatggttcgctttgtcaattcaggcaccgaagcttgcatgggtgcactacgtctcgcccgagcttataccggaagagagaagatcatcaagtttgagggctgttaccatggccatgctgatccttttcttgttaaggcaggtagtggagttgccaccttgggacttcctgattctcccggtgtccccaaagctgccacttttgaaacccttacagccccctacaatgacactgccgccgttgagaagctctttgaggctaacaaaggagaaatcgctgctgttttcctcgaacctgttgttggaaacgctggtttcattgttcctaaacccgattttcataatttcttgcgcaagatcaccaaggagaacaatacccttcttgtgtttgatgaagttatgactgggtttcgtttgtcatacggaggtgctcaagagtattttggcataactcctgatataacaactctaggaaagatcattggtggaggtctgccggtgggggcttatggagggaggagggatattatggagaaggtggcaccagctggcccaatgtatcaggctgggaccttgagtgggaaccctttggccatgactgcaggaatacagaccctgcagcgtattaaggagccaggaacttatgagtacttggacaaaatcaccggtgagcttgttcagggcattattgaagctgggaagagggcaggccatgcaatatgtggtggtcatataagggggatgtttgggtttttcttcacagaaggaccagtgtataattttgcagatgccaaaaagagtgatacggacaagtttgctaggttcttttggggaatgttggcggaaggtgtctatttggcaccttcccagtttgaggctggctttaccagcttggcacatacctctgatgacataaaaaagacaatagccgctgctgagaaggttttcagggagatctga

SEQ ID NO: 442 - protein, 470 aa, Glycine max
MAVSAITGARLTLGIGLAIPLSSPTRSRTVAMAVSVDPKTDNKLTLTKSEEAFAAAKELMPGGVNSPVRAFKSVGGQPIVIDSVKGSRMWDIDGNEYIDYVGSWGPAIIGHADDQVLSALVETMKKGTSFGAPCLLENTLAELVINAVPSIEMVRFVNSGTEACMGALRLARAYTGREKIIKFEGCYHGHADPFLVKAGSGVATLGLPDSPGVPKAATFETLTAPYNDTAAVEKLFEANKGEIAAVFLEPVVGNAGFIVPKPDFHNFLRKITKENNTLLVFDEVMTGFRLSYGGAQEYFGITPDITTLGKIIGGGLPVGAYGGRRDIMEKVAPAGPMYQAGTLSGNPLAMTAGIQTLQRIKEPGTYEYLDKITGELVQGIIEAGKRAGHAICGGHIRGMFGFFFTEGPVYNFADAKKSDTDKFARFFWGMLAEGVYLAPSQFEAGFTSLAHTSDDIKKTIAAAEKVFREI

SEQ ID NO: 443 - DNA, 1401 bp, Glycine max
atggctgtttcggctatcactggagcgaggctaactctagggatgtctctttcctcttccacgcgatcacgaaccgtcgcaatggccgtatctatcgaccccaagaccgataacaaactcactcttaccaagtccgaggaagctttcgctgcggccaaggagctgatgcctggaggcgtgaactccccagttcgtgccttcaaatccgtgggtggtcaaccaattgtgattgattcagtcaaagggtctcgtatgtgggatatcgatggcaatgagtacattgactacgttggttcctggggtcctgcaatcattggtcacgctgatgatcaggtgcttgcagctctgggtgaaaccatgaagaaaggaaccagctttggtgcaccctgtctgctggaaaacactttggcagagctggttatcgatgccgtccccagcattgaaatggttcggtttgtcaattcaggcactgaagcttgcatgggtgcgctccgtctggcccgtgcttataccggaagagagaagatcatcaagtttgagggctgttaccatggccatgctgatccttttcttgttaaggcaggtagtggagttgccaccttaggacttcctgattctcccggtgtccccaaagctgccacttttgaaacccttacagccccctacaatgacaccgaggccattgagaaactcttcgaggccaacaaaggagaaattgccgcagttttcctcgaacctgttgttggaaacgctggtttcattgttcctaagcctgattttcatagtttcttgcgcaagatcaccaaggagaacaatacccttcttgtgtttgatgaagtcatgactggatttcgtttgtcatatggaggtgctcaagagtattttggcataactccagatataacaactctaggaaagatcattggtggaggtctgccggtaggcgcttatggagggaggagggatattatggagaaggtggcaccagctggcccaatgtatcaggctgggaccttgagtgggaaccctttggccatgactgcaggcatagagaccctgcagcgtattaaggagccaggaacttacgagtacttggacaaaatcactggtgagcttgttgagggcatcatcgaagctgggaagcgggcaggccatgcaatatgtggtgggcatataagggggatgtttgggtttttcttcacagaaggaccagtgtataattttgcagatgccaaaaagagtgatacggccaagtttgctaggttcttttggggaatgctggcggaaggtgtctatttggcaccttcccagtttgaggctggcttcaccagcttggcacatacttctgatgacataaaaaagacgatagccgctgctgagaaggttttcagggagatctga

SEQ ID NO: 444 - protein, 466 aa, Glycine max
MAVSAITGARLTLGMSLSSSTRSRTVAMAVSIDPKTDNKLTLTKSEEAFAAAKELMPGGVNSPVRAFKSVGGQPIVIDSVKGSRMWDIDGNEYIDYVGSWGPAIIGHADDQVLAALGETMKKGTSFGAPCLLENTLAELVIDAVPSIEMVRFVNSGTEACMGALRLARAYTGREKIIKFEGCYHGHADPFLVKAGSGVATLGLPDSPGVPKAATFETLTAPYNDTEAIEKLFEANKGEIAAVFLEPVVGNAGFIVPKPDFHSFLRKITKENNTLLVFDEVMTGFRLSYGGAQEYFGITPDITTLGKIIGGGLPVGAYGGRRDIMEKVAPAGPMYQAGTLSGNPLAMTAGIETLQRIKEPGTYEYLDKITGELVEGIIEAGKRAGHAICGGHIRGMFGFFFTEGPVYNFADAKKSDTAKFARFFWGMLAEGVYLAPSQFEAGFTSLAHTSDDIKKTIAAAEKVFREI

SEQ ID NO: 445 - DNA, 1410 bp, Hordeum vulgare
atggccggagcagcagccgccgtggcctccggcatatcgatcaggcctgtagccgcgcctaagatctcgcgcgcgccccgctctcggtcggtggtgagggcggccgtctccatagacgagaaggcttacacggttcagaaatccgaggagatcttcaacgccgccaaggaattgatgcctggtggtgttaattcaccagtccgtgccttcaaatcagtcggcgggcagcccatagtttttgattctgtgaagggctctcatatgtgggatgtcgatggaaatgaatatattgattatgttggttcctggggtcctgcaatcattggtcatgcagatgacaaggtgaatgctgcacttattgaaactctgaagaagggtactagctttggtgctccatgtgcgttggagaatgtgttggctcaaatggtcatctccgctgtgccgagtatcgaaatggttcgttttgtaaattcaggaacagaagcttgcatgggagcactccgccttgtgcgtgcattcactgggagggaaaagattctcaagtttgaaggctgttaccatggccatgcagattccttccttgttaaagcaggcagtggtgttgccaccctcggcctcccagactcccctggagtgcctaagggagccaccgttgggactctaacagcaccttataatgatgctgatgcggttaaaaagctgtttgaggataacaaaggggagattgctgcagtcttccttgagccggttgttggcaatgctggcttcattcctccgcagcctgctttcctaaatgctctccgtgaggtgaccaaacaagacggtgcacttctggtgtttgatgaagtgatgactggtttccgtttagcttatggtggggcacaagagtactttggaatcacccctgatgtgacaaccttggggaaaattattggcggtggtcttccggttggtgcttacggtggacggaaggatatcatggagatggttgctccagcagggccaatgtaccaggcaggaaccctcagtggaaaccctctagctatgactgctggaatccacactctcaagcgtctgatggagcctggcacctatgaatacttagacaaggtcactggtgaacttgtccggggcatattggatgtgggcgctaaaacagggcacgagatgtgtggaggacacatcagaggcatgttcggattcttcttcgcaggtggcccagtgcacaactttgatgatgccaagaagagtgacacagcgaagtttgggaggttccaccgtggaatgctggaagaaggcgtgtatctggcaccatcccagttcgaggcaggttttacaagcttggcacacaccacccaagacattgagaaaaccgtggaggctgccgagaaggttcttcgatggatatag

SEQ ID NO: 446 - protein, 469 aa, Hordeum vulgare
MAGAAAAVASGISIRPVAAPKISRAPRSRSVVRAAVSIDEKAYTVQKSEEIFNAAKELMPGGVNSPVRAFKSVGGQPIVFDSVKGSHMWDVDGNEYIDYVGSWGPAIIGHADDKVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDADAVKKLFEDNKGEIAAVFLEPVVGNAGFIPPQPAFLNALREVTKQDGALLVFDEVMTGFRLAYGGAQEYFGITPDVTTLGKIIGGGLPVGAYGGRKDIMEMVAPAGPMYQAGTLSGNPLAMTAGIHTLKRLMEPGTYEYLDKVTGELVRGILDVGAKTGHEMCGGHIRGMFGFFFAGGPVHNFDDAKKSDTAKFGRFHRGMLEEGVYLAPSQFEAGFTSLAHTTQDIEKTVEAAEKVLRWI

SEQ ID NO: 447 - DNA, 1407 bp, Medicago truncatula
atggctgcttcgggtattgcagggcttacccttctcaattgcttctcttcttcttcagcgagatgtcgaactcgttctttgactatggctgtttccaccgaccagaagcccagcaccgaaaaactcactctccgcaaatctgaagaagctttcgccgctgcaaaggaattgatgcctggaggtgtgaactctcctgttcgtgctttcaaatcagttggtggacaacccattatcattgattccgtcaaaggtgctcgaatgtgggacattgatggcaaccaatacattgactatgttggttcttggggtcctgcaattattggtcacgctgatgatcaggtactcgccgctcttgctgagacaatgaagaaaggaaccagctttggtgcaccttgtcttcttgaaaacactctagctgagatggttatctctgctgttcccagcattgaaatggtcagatttgtcaattccggcacagaagcatgtatgggtgcactccgccttgcacgtgcttataccggcaaagagaagatcatcaagtttgagggatgttatcacggccatgctgatccttttcttgttaaggcaggcagtggagttgccaccctaggacttcctgattcccctggtgttcctaaagctgccaccaatgaaacccttacagcccccttcaatgactttgctgctgttgagaagatctttgaagccaacaaaggagagatagctgtagtcttcctcgaacctgttgttggaaattcgggtttcattactcctaaacctgatttccttagttccttgcgcaaaatcaccaaggagaacaatgcccttctcgtgtttgatgaagttatgactggatttcgtttgtcgtatggaggtgctcaagaatactttggcataactcctgatataacaactctggggaagatcattggagggggtttgccagtaggtgcatatggaggtaggagagatattatggagacggtggctccggctggacctatgtaccaggctgggacgttgagtgggaaccctttggcaatgactgccggcatagaaactctgaagcgtattaaggagccaggaacttatgaatacttggacaaaattacaggtgagcttgttcaaggcattgttgaagctggtaagagagcagggcatgcaatatgtggtgggcatataaatgggatgtttgggtttttcttcacagaaggacctgtgtacaatttcacagatgcaaaaaagagtgacactgccaagtttgctaagttcttctggggtatgttagcagaaggtgtctatttggcaccttcacagtttgaagctgggttcaccagcttggcacatacttctgatgacatcaagaagaccattgctgctgctgagaaggtctttagggagatctga

SEQ ID NO: 448 - protein, 468 aa, Medicago truncatula
MAASGIAGLTLLNCFSSSSARCRTRSLTMAVSTDQKPSTEKLTLRKSEEAFAAAKELMPGGVNSPVRAFKSVGGQPIIIDSVKGARMWDIDGNQYIDYVGSWGPAIIGHADDQVLAALAETMKKGTSFGAPCLLENTLAEMVISAVPSIEMVRFVNSGTEACMGALRLARAYTGKEKIIKFEGCYHGHADPFLVKAGSGVATLGLPDSPGVPKAATNETLTAPFNDFAAVEKIFEANKGEIAVVFLEPVVGNSGFITPKPDFLSSLRKITKENNALLVFDEVMTGFRLSYGGAQEYFGITPDITTLGKIIGGGLPVGAYGGRRDIMETVAPAGPMYQAGTLSGNPLAMTAGIETLKRIKEPGTYEYLDKITGELVQGIVEAGKRAGHAICGGHINGMFGFFFTEGPVYNFTDAKKSDTAKFAKFFWGMLAEGVYLAPSQFEAGFTSLAHTSDDIKKTIAAAEKVFREI

SEQ ID NO: 449 - DNA, 1449 bp, Nicotiana benthamiana
atggccgcttcaagtggcgcaaggattttatggcagtcgaattttactcagtgtcaaagacccacattggtttcctctccatctccccgccgatgcattccatgttcttcttctactgcaactaccatcaggatgactgtttcagttgatgaaaagcagaaaacctatactcttcaaaagtctgaagaagcttttaataaagctaaggagttgatgccaggtggtgtaaattctcctgtacgtgctttcaagtcagttggcggacaacctgttgtgatcgactctgtgaagggttctcatatgtgggatatagatggtaatgagtacattgattatgtcggttcatgggggccagctatcattggccatgcagatgacgaggtgctagcagccttggctgagacaatgaagaaaggaacaagttttggtgctccatgcctcctcgaaaatactttggcagaaatggttatttctgctgttcctagtattgaaatggttcgtttcgtcaactctggcacagaggcatgcatgggggttctacggttggctcgtgcatttaccggccggtcaaagattataaagtttgagggttgctaccatggtcatgccgatccatttcttgttaaagcaggcagtggagttgccactctaggactaccggactcccctggagttcccaaggcagccacacaagatactctgacagctccctacaatgatatttctgctattaagagcctctttgatgacaacaaaggagaaattgcagctataatacttgagcccgtcgttgggaattctggctttattccacccaaactggaatttctagatgtccttcgcgatattaccaaagaaaatggtgctctacttatttttgatgaagttatgacaggatttaggttggcatatggtggcgctcaggagtattttggaataacccctgatttgacaacacttgggaagattatcggcgggggcttgccagtaggtgcctatggaggaaggagggatattatgcagatggtggcaccagcaggaccaatgtatcaggctgggaccctaagcgggaacccattggctatgactgctggtattaacacacttaagcggttaaagcaaccgggagcatatgaacacttggacaagatcactggtgaacttattcagggaatattggatgctgggaagaagactggtcatgcaatgtgtggtgggtatattagcggaatgtttggcttctttttcacacatggaccagttcataacttttcggatgcaaagaagagtgatgctgccaaatttgccaaattttatagagggatgctggaggaaggtgtctatcttgcgccatcccagtttgaggctggatttactagcttagcacacactgtagaggatatccaacagacaatagctgctgctgaaaaagttttgaggcaactttag

SEQ ID NO: 450 - protein, 482 aa, Nicotiana benthamiana
MAASSGARILWQSNFTQCQRPTLVSSPSPRRCIPCSSSTATTIRMTVSVDEKQKTYTLQKSEEAFNKAKELMPGGVNSPVRAFKSVGGQPVVIDSVKGSHMWDIDGNEYIDYVGSWGPAIIGHADDEVLAALAETMKKGTSFGAPCLLENTLAEMVISAVPSIEMVRFVNSGTEACMGVLRLARAFTGRSKIIKFEGCYHGHADPFLVKAGSGVATLGLPDSPGVPKAATQDTLTAPYNDISAIKSLFDDNKGEIAAIILEPVVGNSGFIPPKLEFLDVLRDITKENGALLIFDEVMTGFRLAYGGAQEYFGITPDLTTLGKIIGGGLPVGAYGGRRDIMQMVAPAGPMYQAGTLSGNPLAMTAGINTLKRLKQPGAYEHLDKITGELIQGILDAGKKTGHAMCGGYISGMFGFFFTHGPVHNFSDAKKSDAAKFAKFYRGMLEEGVYLAPSQFEAGFTSLAHTVEDIQQTIAAAEKVLRQL

SEQ ID NO: 451 - DNA, 1437 bp, Nicotiana tabacum
atggctgctgtaaatggtgttggaatttcatggccatctaaattgactcaaagtcaaagacccaaattggttttctctccatctccccgtcgatgcaccccatcttcttcaacaattaaaatgactgcatcagttgatgaaaagaagaaaactttcactcttcaaaagtctgaagaagctttcagcaaagccaaggagttgatgccaggaggtgtaaattcccctgttcgcgctttcaagtcagttggcggacaacctatcattattgactccgtgaagggctctcgtatgcgggacatagatggtaacgactacattgactatgtcggatcatggggtccagctataatcggtcatgcagatgatgaggtgttagcagcattggctgaaacaatgaagaaaggaacgagttttggtgctccatgtctccttgaaaacactctggccgagatggttatttcagctgttccaagcatagaaatggttcggtttgtcaactccggtacagaggcgtgcatgggagtactacggctggctcgtgctttcactggccggcctaagatcatcaaattcgagggttgttaccatggtcatgctgatccatttcttgttaaagcaggcagtggtgttgccaccctaggactccccgactcccctggagttccaaaggcagctactactgatacactgacagcgccttacaatgatatttctgctgttgagagcctctttaaggagcacaaaggcgaagtcgctgctataattcttgagcctgtagttggaaatgctggcttcattcaacctaatccagattttcttgctgccattcgcaagatcaccaaagaaaatgatgcacttcttattttcgacgaagtcatgactggatttaggttggcatatggcggagctcaggagtattttggaataactccagatttgaccacacttgggaagattatcggcggtggcttgccagtaggtgcatacggaggaaggcgggatattatggagatggtagcacctgcaggtccgatgtatcaggccgggacactaagtggaaacccattggccatgactgctggaattcacacgcttaagcggttacagggaccgggtacatacgactacttggacaagatcacgggtgaacttactcaaggaatcttggatgctggaaagaagaccgggcatgcaatgtgtggcgggtacataagggggatgtttggcttctttttcgtggagggtcctgtcaataacttttcggatgcaaagaagagtgatacagaaaaatttggcagattctataggggaatgctggaggaaggtgtatattttgcaccatcacagtttgaggctggatttactagcttagcacacacttcagaggacattcaaaggacggtagctgcagctgaaaaagttcttaagcaaatttaa

SEQ ID NO: 452 - protein, 478 aa, Nicotiana tabacum
MAAVNGVGISWPSKLTQSQRPKLVFSPSPRRCTPSSSTIKMTASVDEKKKTFTLQKSEEAFSKAKELMPGGVNSPVRAFKSVGGQPIIIDSVKGSRMRDIDGNDYIDYVGSWGPAIIGHADDEVLAALAETMKKGTSFGAPCLLENTLAEMVISAVPSIEMVRFVNSGTEACMGVLRLARAFTGRPKIIKFEGCYHGHADPFLVKAGSGVATLGLPDSPGVPKAATTDTLTAPYNDISAVESLFKEHKGEVAAIILEPVVGNAGFIQPNPDFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGPGTYDYLDKITGELTQGILDAGKKTGHAMCGGYIRGMFGFFFVEGPVNNFSDAKKSDTEKFGRFYRGMLEEGVYFAPSQFEAGFTSLAHTSEDIQRTVAAAEKVLKQI

SEQ ID NO: 453 - DNA, 1437 bp, Nicotiana tabacum
atggctgctgtaaatggtgtaggaatttcatggccatctaaattgactcaaggtcaaagacccaaattggttttctctccatctccccgccgatgcaccccatcttcttcaacaattaaaatgacagcatcagttgatgaaaagaagaaaactttcactcttcaaaagtctgaagaagcttttagcaaagccaaggagttgatgccaggaggtgtaaattccccagttcgtgctttcaagtcagttggcggacaacctatcattattgactccgtgaagggctctcgtatgcgggacatagatggtaacgagtacattgactatgtcggatcatggggtccagctataatcggtcatgcagatgatgaggtgttagcagcattggctgaaacaatgaagaaaggaacgagttttggtgctccatgtctccttgaaaacactctggccgagatggttatttcagctgttccaagcatagaaatggttcggttcgtcaactctggtacagaggcatgcatgggagtactacggctggctcgtgctttcactggccggcctaagatcatcaaattcgagggttgttaccatggtcatgctgatccatttcttgttaaagcgggcagtggtgttgccaccctaggactccccgactcccctggaggtccaaaagcagctacttctgatacactgacagcaccttacaacgatatttctgctgttgagagcctctttgaggagcacaaaggcgaagtcgctgctataattcttgagcctgtagttggaaatgctggcttcattcaacctaatctagattttcttgctgccattcgcaagatcaccaaagaaaatgacgcacttcttatttttgacgaagtcatgactggatttaggttggcatacggcggagctcaggagtattttggaataactccagacttgacgacacttgggaagattatcggcggtggcttgccagtaggtgcatacggaggaaggcgggatattatggagatggtagcacctgcaggaccgatgtatcaagccgggaccctaagtggaaatccattggccatgactgctggaattcacacgcttaagcgattacagggaccgggtacatacgaatacttggacaagatcaccggtgaacttacacagggaatcttggatgctggaaagaagaccggtcatgcaatgtgtggcgggtacataagggggatgtttggcttccttttcgcggagggtcctgtcaataacttttcggatgcaaagaagagtgatacagaaaaatttggcagattctataggggaatgctggaggaaggtgtatattttgcaccatcacagtttgaggctggatttactagcttagcacacacttcagaggatattcaaaagacagtagctgcagctgaaaaagttctaaagcaaatttaa

SEQ ID NO: 454 - protein, 478 aa, Nicotiana tabacum
MAAVNGVGISWPSKLTQGQRPKLVFSPSPRRCTPSSSTIKMTASVDEKKKTFTLQKSEEAFSKAKELMPGGVNSPVRAFKSVGGQPIIIDSVKGSRMRDIDGNEYIDYVGSWGPAIIGHADDEVLAALAETMKKGTSFGAPCLLENTLAEMVISAVPSIEMVRFVNSGTEACMGVLRLARAFTGRPKIIKFEGCYHGHADPFLVKAGSGVATLGLPDSPGGPKAATSDTLTAPYNDISAVESLFEEHKGEVAAIILEPVVGNAGFIQPNLDFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGPGTYEYLDKITGELTQGILDAGKKTGHAMCGGYIRGMFGFLFAEGPVNNFSDAKKSDTEKFGRFYRGMLEEGVYFAPSQFEAGFTSLAHTSEDIQKTVAAAEKVLKQI

SEQ ID NO: 455 - DNA, 1410 bp, Ostreococcus lucimarinus
atgttcgccgcgacgacgacgctcggcgcgacgaaattcgtcgtcgcgaaaacctcgacgtcgacctcgtcgcgcgcgcgacgatcgacgccgcgcgttcgcgcgcagagcgtccaggcgccggcgctgaacacgacgcgatcgagcgagatcttcaaggcggcgcaagacatcctgccgggaggcgtgaactcgcccgtgcgcgcgttcaagtcggtgggcgggaacccgatcgtgttcgagcgcgtcaaggatgcgtacgcgttcgacgtggacgggaacaaatacgtcgattacgtcggatcgtggggaccggcgatctgcggacacgcgaatgatcgggtgaacgagaaattgaaggcgcagatcgataaggggacgagcttcggggcgccgtgtgagctcgagaacgcgctcggcgagatggtcatcgagcgcgtgccgagcgtggagatggtgcgattttgcaactctgggacggaggcgtgcttgtccgcgctgcgcgtgatgcgggcgtacacggggagagacatgatcattaagttcgaagggtgctaccacggacacgccgacccgttcttggtcaaggctggttcgggcgtcatcacgctcgggttgccggattcgccgggcgtgccggcggcggcgacggcgacgacgctgtgcgcgacgtacaacaacctcgatgaagtcaaggctttgttcgcggcgaacccgggtaagattgcgggggtgatcctcgaacccgtggtcgggaacagcggtttcatcgccccggacaaggagtttttgcaaggcttgcgcgagacgtgcaccaaggagggcgcggtgctgtgctttgacgaagtcatgactgggttccgcatcgccaagggctgcgcgcaagagtactggggcgtcaccccggatttgaccaccatgggtaaggtgatcggcggcggtatgcccgtcggcgcgtacgggggtaagcgcgaaatcatggacatggtcgccccggcgggtccgatgtaccaagccggtacgctctccgggaacccgctcgccatggttgctggcatcgaaacgttgaagattctcggcgaaccgggtcagtacgaaaagttggacaagctcaccaagcgcttgatcgagggcatcttgaaggcgggtaaggacaacggccacgcggtgtgcggcggtcacatctcgggcatgtttggtttcttcttcaccgaaggtccggtgaagaacttcgccgacgcggcgaagagcgacaccgaaaagttcggtcgctggcaccgtgccatgctcgaagaaggtgtctacttggccccgtcccaatacgaagccggtttcatgtctttggcgcacaccgaagcggacattgacgccaccatcgccgccgctcaacgcgcgatggcgcgcatttaa

SEQ ID NO: 456 - protein, 469 aa, Ostreococcus lucimarinus
MFAATTTLGATKFVVAKTSTSTSSRARRSTPRVRAQSVQAPALNTTRSSEIFKAAQDILPGGVNSPVRAFKSVGGNPIVFERVKDAYAFDVDGNKYVDYVGSWGPAICGHANDRVNEKLKAQIDKGTSFGAPCELENALGEMVIERVPSVEMVRFCNSGTEACLSALRVMRAYTGRDMIIKFEGCYHGHADPFLVKAGSGVITLGLPDSPGVPAAATATTLCATYNNLDEVKALFAANPGKIAGVILEPVVGNSGFIAPDKEFLQGLRETCTKEGAVLCFDEVMTGFRIAKGCAQEYWGVTPDLTTMGKVIGGGMPVGAYGGKREIMDMVAPAGPMYQAGTLSGNPLAMVAGIETLKILGEPGQYEKLDKLTKRLIEGILKAGKDNGHAVCGGHISGMFGFFFTEGPVKNFADAAKSDTEKFGRWHRAMLEEGVYLAPSQYEAGFMSLAHTEADIDATIAAAQRAMARI

SEQ ID NO: 457 - DNA, 1296 bp, Ostreococcus RCC809
atggatgatttgttgaacacgaagaagagcgaagccatcttcaaggcggcgcaagatatcttacccggtggggtgaactcgcccgtgcgagcgtttaaatcggtcggtggacaaccgatcgtgttcgacaaggttaaggacgcgtacgcgttcgacgtggacgggaacaagtacgtcgattacgtcggctcgtggggtccggcgatctgtggacacgcgaacgaacgagtgaatgaaaagttaaaggcgcagatcgataaggggacgtcgttcggtgcgccgtgtgagttggaaaatatcttgggcgagatggtgatcgaacgcgtgccgagcgtggagatggtgcgcttttgcaactctggtaccgaggcgtgcttgtccgcgttgcgcgtgatgcgcgcgtacaccggtcgggacatgatcatcaagttcgaggggtgctaccacggtcacgccgatccgttcctcgtcaaggcgggttcgggcgtcatcaccctcggcttgccggattctccgggcgtgccggcggcggccacctcgacgacgctctgcgcgacgtacaacgatctcgatgaggtcaaggctttgtttgccgaacacaaggacaagatcgcgggcgtcatcttggaaccggtcgtcggtaactctggtttcatcgttccggataaggaattcttgcaaggcttgcgcgaggtgtgcaccgccgagggcgccgtcttgtgctttgacgaagtcatgaccggcttccgcatcgccaagggttgcgcgcaagagtactggggcgtcaccccggatttgaccaccatgggtaaggttatcggtggcggtatgccggtcggcgcgtacggcggtaagcgcgaaatcatggacatggtcgccccggcgggtccgatgtaccaagcgggcaccttgtccggtaacccgctcgccatggtcgccggtatcgagaccctctccatcttgggcgaaccgggtcagtacgaaaagctggacaagatgaccaagcgcttgatcgagggcatcttgaaggcgggtcgcgacaacggccacgcggtgtgcggcggctccatctccggcatgtttggtttcttcttccaagagggtccggtgaagaactttgccgacgcggcgaagagcgacaccgacaagttcggccgctggcacagagcgatgctcgaggagggcgtctacctcgcgccgtcctcgtacgaagccggtttcacctctttggcgcacactgaggaggacatcgacttcaccatcgccgccgcgcagcgcgccatggctcgcatctaa

SEQ ID NO: 458 - protein, 431 aa, Ostreococcus RCC809
MDDLLNTKKSEAIFKAAQDILPGGVNSPVRAFKSVGGQPIVFDKVKDAYAFDVDGNKYVDYVGSWGPAICGHANERVNEKLKAQIDKGTSFGAPCELENILGEMVIERVPSVEMVRFCNSGTEACLSALRVMRAYTGRDMIIKFEGCYHGHADPFLVKAGSGVITLGLPDSPGVPAAATSTTLCATYNDLDEVKALFAEHKDKIAGVILEPVVGNSGFIVPDKEFLQGLREVCTAEGAVLCFDEVMTGFRIAKGCAQEYWGVTPDLTTMGKVIGGGMPVGAYGGKREIMDMVAPAGPMYQAGTLSGNPLAMVAGIETLSILGEPGQYEKLDKMTKRLIEGILKAGRDNGHAVCGGSISGMFGFFFQEGPVKNFADAAKSDTDKFGRWHRAMLEEGVYLAPSSYEAGFTSLAHTEEDIDFTIAAAQRAMARI

SEQ ID NO: 459 - DNA, 1437 bp, Oryza sativa
atggccggagcagcagccgcctccgccgccgccgccgccgtggcgtccgggatctcggcccggccggtggccccgaggccctctccctcgcgcgcgcgcgccccacggtccgtcgtgcgggcggccatctccgtcgagaagggggagaaggcgtacacggtggagaagtccgaggagatcttcaacgccgccaaggagttgatgcctgggggtgttaattcaccagttcgtgccttcaaatcagttggtgggcagcccattgtgtttgattctgtgaagggttctcgtatgtgggatgtggatggaaatgaatatatcgattatgttggttcctggggtcctgcgatcatcggtcatgcagatgatacggtgaatgcagcattgattgaaactctaaagaaaggaactagctttggcgctccatgtgtgttggagaatgtgttggctgagatggtcatctctgctgtaccaagtatcgaaatggtccgttttgtcaattcagggacagaagcctgcatgggagcgctgcgccttgtgcgtgcattcactgggagagagaagattctcaagtttgaaggttgttaccatggccatgcagattccttccttgttaaagctggcagtggtgttgccacccttggcctcccagactcccctggagtccccaagggagccacatctgagactctaacggcaccatacaatgatgtcgaggcagtgaaaaaactgtttgaggagaacaaagggcagattgctgctgtcttccttgagcccgttgttggcaatgctggcttcattcctccacagcccggttttctgaatgctctccgtgacttgacgaaacaagacggtgcacttttggtctttgatgaagtgatgacgggtttccgtttagcttatggtggggctcaagaatacttcgggatcacccctgatgtgtcaacattggggaaaatcatcggtggcggtcttccagttggcgcttatggtggacgtaaggacatcatggagatggttgctccagcagggccaatgtaccaggcaggaaccctcagtggaaaccctctagctatgactgctggaatccacacactcaagcgtctgatggagcctggaacctacgattacttggacaagatcactggtgatcttgttcgcggggtattggacgcgggtgcgaaaactggacatgagatgtgtggaggacacatcagggggatgttcgggttcttcttcaccgctggcccagttcacaactttggtgacgcgaagaagagtgacaccgccaagtttgggaggttctaccggggcatgcttgaagaaggtgtgtacctagctccatcccagtttgaggcaggtttcaccagcttggcacacacctcccaggacatcgaaaaaaccgtggaggcagctgcgaaagttcttcgccggatatag

SEQ ID NO: 460 - protein, 478 aa, Oryza sativa
MAGAAAASAAAAAVASGISARPVAPRPSPSRARAPRSVVRAAISVEKGEKAYTVEKSEEIFNAAKELMPGGVNSPVRAFKSVGGQPIVFDSVKGSRMWDVDGNEYIDYVGSWGPAIIGHADDTVNAALIETLKKGTSFGAPCVLENVLAEMVISAVPSIEMVRFVNSGTEACMGALRLVRAFTGREKILKFEGCYHGHADSFLVKAGSGVATLGLPDSPGVPKGATSETLTAPYNDVEAVKKLFEENKGQIAAVFLEPVVGNAGFIPPQPGFLNALRDLTKQDGALLVFDEVMTGFRLAYGGAQEYFGITPDVSTLGKIIGGGLPVGAYGGRKDIMEMVAPAGPMYQAGTLSGNPLAMTAGIHTLKRLMEPGTYDYLDKITGDLVRGVLDAGAKTGHEMCGGHIRGMFGFFFTAGPVHNFGDAKKSDTAKFGRFYRGMLEEGVYLAPSQFEAGFTSLAHTSQDIEKTVEAAAKVLRRI

SEQ ID NO: 461 - DNA, 1317 bp, Ostreoccocus taurii
atgcgagcgatgcaggcgagagaatgcgcgacgcgccgaagtgggtttgggttatccacgggcgcgcgcgggcgacgcgcggtgacgcgagcggtgcgcgcgcccgagctgaacacgacgcgatcgaatgaaatcttcacggcggcgcaagatatcctcccggggggggtgaactcgccggtgcgggcgtttaagagcgtcgggggggggccgatcgtgttcgagcgcgtcaaggatgcgtacgcgttcgacgtcgacgggaacaagtacgtggattacgttggatcttggggtccggcgatctgtggacacgcgaatgaacgcgtgaacgctaaactcaaggcgcagatcgataaggggacgtcctttggggcgccgtgcgagttggaaaacatcttggggcaaatggtgatcgatcgcgtgccgagcgtggagatggtgcgattctgtaactcgggcaccgaggcgtgcctgtcggcgcttcgcgtgatgcgcgcgtacacgggtcgggataagatcatcaagtttgagggatgctaccacggacacgccgaccccttcttggtcaaggcgggttcgggcgtcatcacgctcgggttgccggattctccgggtgtcccggccgccgcgacggcgaccacgctgtgcgcgacgtacaacaacctcgaagaggtcaaggcgctgttcgaggcgaacaagggtgagattgccggcgtgattcttgaacccgtggaattcttgcaaggcttgagagacgtgtgcaccgcggaaggcgccgtgttgtgcttcgacgaggtcatgactggtttccgcatcgccaaggggtgcgcccaagagcactggggcgtcacgccagatttgaccaccatgggtaaggtcatcggcggcggcatgcccgtcggcgcgtacgggggcaagcgagagatcatggacgtcgtcgccccggccggtccgatgtaccaagcgggcacgttgtccgcatctggtgagccgggtcagtacgaaaagttggacaagattaccaagcgcttgatcgagggcatcttgaagccgggtagggacaacggccacgcggtgtgcggcggtcacatcagcggcatgtttggtttcttcttcaccgaaggtccggttaagaacttcacggacgcggcgaagagtgacacggccaagttcggccgctggcaccgcgccatgctcgaggagggcgtgtacctcgcgccgagccaattcgaagccggctttacgtccttggcgcacaccgaggaagacatcgacgccacgatcgccgccgcccagcgcgccatggctcgcatttaa

SEQ ID NO: 462 - protein, 438 aa, Ostreococcus taurii
MRAMQARECATRRSGFGLSTGARGRRAVTRAVRAPELNTTRSNEIFTAAQDILPGGVNSPVRAFKSVGGGPIVFERVKDAYAFDVDGNKYVDYVGSWGPAICGHANERVNAKLKAQIDKGTSFGAPCELENILGQMVIDRVPSVEMVRFCNSGTEACLSALRVMRAYTGRDKIIKFEGCYHGHADPFLVKAGSGVITLGLPDSPGVPAAATATTLCATYNNLEEVKALFEANKGEIAGVILEPVEFLQGLRDVCTAEGAVLCFDEVMTGFRIAKGCAQEHWGVTPDLTTMGKVIGGGMPVGAYGGKREIMDVVAPAGPMYQAGTLSASGEPGQYEKLDKITKRLIEGILKPGRDNGHAVCGGHISGMFGFFFTEGPVKNFTDAAKSDTAKFGRWHRAMLEEGVYLAPSQFEAGFTSLAHTEEDIDATIAAAQRAMARI

SEQ ID NO: 463 - DNA, 1440 bp, Physcomitrella patens
atgacgggctccgctgtccgtgcccgtgagtggtcaggattgagacctgccgaccaacttaaggccaccccagttgcccgaggtgatagccacattgctttctcgaggaagggtcatgtggtgcaaatgacactctccgtagagaagaagcaatttacgacacaaaagtctgaagagacattcaacgctgccaaggagctgatgcccggaggtgttaactctcctgtgagagcattcaaatcggttggagggcaaccaattgtctttgaccgagtgaaaggttccaaggcctgggatatcgacggcaatgaatacgtcgattacgtcggctcatggggtcccgctatcattggtgcttgcgacgatcaggtgaatgaggagctcgtcaaaacgctccagaagggtaccagtttcggtgctccatgcgttttggagaatgtgttagcacaaatggtgattgacgcagttcccagcgtcgagatggtgcggttcgtgaactctggaaccgaggcttgcatgggcatgctccgtcttgctcgtgcatacactggacgcgagaaggttcttaagttcgagggatgttaccacggacatgcggattcttttctggtaaaagccggcagtggtgtcgccactttgggtctcccagactctcctggtgttccctcctcttccacagcatctacactgacagcagcttacaacgacctcgaggcagtgaaggagatctttgccaagtacaaaggagaaattgctgccgtggtgttagagcccgtcgtgggaaatgctggtttcattatccccaagaaggagttcctgcaagggctccgggacctcaccagtgaagatggagcctgtcttgtcttcgacgaggtcatgactgggttccgcatctcatatggaggtgcccaagagtacttcggaatcacgcctgatatcactaccctggggaagatcattggtggaggactccctgtgggtgcctatggaggaaagagggagatcatggagatggttgctcccgccggaccaatgtatcaggccggtaccctaagtggcaacccgctcgcaatgacggctggaatccacactctccgcaggctgcaacagtctggctcgtacgagcaattggacagggttaccgggaagctcattcagggaatcctcgacgctgggcgagaggctgggcatgaggtttgcggtgggcacatcagtggaatgttcggattcttcttctgtgccggtcctgtaaacaactttgaagatgccaagaagagtgacactgccaagttcgccgcctttcacagcaggggcatgcttgaaagaggcgtttatcttgcaccttcacaatttgaggctggcttcacaagcctagctcacacagacgaggacatcgacttcaccattgctgccgctaaggaagtgatgaagtcactttga

SEQ ID NO: 464 - protein, 479 aa, Physcomitrella patens
MTGSAVRAREWSGLRPADQLKATPVARGDSHIAFSRKGHVVQMTLSVEKKQFTTQKSEETFNAAKELMPGGVNSPVRAFKSVGGQPIVFDRVKGSKAWDIDGNEYVDYVGSWGPAIIGACDDQVNEELVKTLQKGTSFGAPCVLENVLAQMVIDAVPSVEMVRFVNSGTEACMGMLRLARAYTGREKVLKFEGCYHGHADSFLVKAGSGVATLGLPDSPGVPSSSTASTLTAAYNDLEAVKEIFAKYKGEIAAVVLEPVVGNAGFIIPKKEFLQGLRDLTSEDGACLVFDEVMTGFRISYGGAQEYFGITPDITTLGKIIGGGLPVGAYGGKREIMEMVAPAGPMYQAGTLSGNPLAMTAGIHTLRRLQQSGSYEQLDRVTGKLIQGILDAGREAGHEVCGGHISGMFGFFFCAGPVNNFEDAKKSDTAKFAAFHSRGMLERGVYLAPSQFEAGFTSLAHTDEDIDFTIAAAKEVMKSL

SEQ ID NO: 465 - DNA, 1461 bp, Physcomitrella patens
atggctgcacaggctgtttcggtgggcactgctctgggtgcccgggagtggtcagggttgaggcctgccgatccatttaaggcagccccagcggcagccagagctgatacccagatcggtgtttcgaagaagggtcgtgtggttcagatgacgatttctgtggagaagaaacaattcacgacgaagaagtccgaagagaccttcgctgctgccaaggagctgatgcctggaggtgtcaattctcctgttagagcattcaagtccgttggaggacaaccaattgtcttcgaccgagtgaaagggtccaaggcctgggacatcgacggcaaccagtacgtggactacgttggctcatggggacctgccatcgtcggtgcttgtgacgagcaagtgaatgaggagctcattagaacattgcagaagggtaccagcttcggagcaccttgtgtcttggagaatgtgttggcacaaatggtgattgatgcagttcccagcattgagatggtgcggttcgtgaactccggaactgaggcctgcatgggcatgctccgtctggcccgtgcatacaccggtcgtgagaagattctcaagttcgagggatgttaccacggacacgcggattctttcctggttaaggccggaagtggcgttgcaactctgggcctcccagactctcctggtgtccccagctcttctaccgcatcgactttgacagcagcgtacaacgacctggaggcggtaaaagagatcttcgcgaaatataaaggacagattgctgccgttgtgttggagcccgtcgtgggaaatgccggatttattgtcccgcgccaggagttcttgcaaggtctccgggaccttacaaaagaggatggagcctgtcttgtcttcgacgaggttatgactggattccgcatctcatatggaggtgcccaacagcatttcggaatcacacctgatatcaccactttgggaaagatcatcggaggagggttacctgtaggtgcctacggaggaaaaagagaaatcatgcagatggttgccccagctgggccaatgtaccaggccggtactctaagtggaaacccactcgcaatgacggctggtattcacacactccgtaggctgcaacagccaggtgcatacgaacatttggacagggttaccggaaagctcgtccaaggaatccttcaagcagggcgagatgccgggcacgagatttgcggtggacacatcagtggaatgtttggattcttcttctgtgctggtcctgtgcacaacttcgaagacgcaaagaagagtgacactgctaagttcgctgccttcttcagcaggggcatgcttgaaagaggggtgtatctcgctccttcccaattcgaggcgggctttactagcctcgctcactctgatgaggacattgagttcaccattgctgctgcgaaggacgtgttgaagtcactttga

SEQ ID NO: 466 - protein, 486 aa, Physcomitrella patens
MAAQAVSVGTALGAREWSGLRPADPFKAAPAAARADTQIGVSKKGRVVQMTISVEKKQFTTKKSEETFAAAKELMPGGVNSPVRAFKSVGGQPIVFDRVKGSKAWDIDGNQYVDYVGSWGPAIVGACDEQVNEELIRTLQKGTSFGAPCVLENVLAQMVIDAVPSIEMVRFVNSGTEACMGMLRLARAYTGREKILKFEGCYHGHADSFLVKAGSGVATLGLPDSPGVPSSSTASTLTAAYNDLEAVKEIFAKYKGQIAAVVLEPVVGNAGFIVPRQEFLQGLRDLTKEDGACLVFDEVMTGFRISYGGAQQHFGITPDITTLGKIIGGGLPVGAYGGKREIMQMVAPAGPMYQAGTLSGNPLAMTAGIHTLRRLQQPGAYEHLDRVTGKLVQGILQAGRDAGHEICGGHISGMFGFFFCAGPVHNFEDAKKSDTAKFAAFFSRGMLERGVYLAPSQFEAGFTSLAHSDEDIEFTIAAAKDVLKSL

SEQ ID NO: 467 - DNA, 1497 bp, Populus tremuloides
atggctgctctctcttacaatatctttatcatcatcttgaccagacacagattgagaatggcttctacaatcacaggagttagtgttggtttaggactttcatgttctacaacaagaaagctgactcagaaaagaaatccttcatcatcaaggttgtctttttgcagcattaaaatggctgtctctgttgaagaagagaaaaagaagaagagtttcactcttgaaaaatctgaagaagctttcagcgctgctaaggaaatgatgccaggaggtgtgaattcacctgtacgtgcttttaaatctgttggtggacaacctattgtgtttgattctgtcaagggttctcacatgagggacattgatggaaatgattacattgattatgttggttcttgggggcctgctataattggtcatgcagatgatgaggtacttgcagccttgtctgaaacaatgaagaaagggaccagctttggtgccccttgtcttctagagaatgttttggcagagatggtgatcaaagcagttccaagcatagaaatggtacgatttgttaactcaggcacagaagcatgcatgggtgtgcttcgcctggcccgtgcctacactggacgggagaagattatcaagtttgagggctgttaccatggccatgctgatccattccttgtcaaagcaggtagtggtgttgcaacccttgggctcccagactcgcctggtgtccccaaagcagcaacctatgaaactctaacagccccctataatgacattgctgctgtggaaaatctttttgagaacaacaaaggagagatttgtggaataatccttgaacctgttgtgggaaatgctggtttcatccccccgaaacctgaatttattaatgccattcgcaggatcactgaagaaaataatgctcttctaatatttgatgaagttatgactggattccgtttgtcatacggtggagctcaggagtattttggcataactcctgatttaacaacactagggaagatcattggtggtggtctgccagttggtgcatatggtgggagaagggagattatggagatggttgcacctgcagggccaatgtaccaggccggaaccttgagtgggaatcccttggctatgactgcagggatacacacactgaagcggttgcagaaaccaggaagttacgaatacttggataagattaccagtgaacttgttcagggcattattgatgctggcaagaaaactgggcatgcaatttgtggaggctatatacgtggaatgtttgggtttttctttacggaaggtcctgtttacaactttgctgatgcaaagaaaagtgacacagcaaagttcgccagattttaccaaggaatgctgagggagggtgtatactttgcaccgtcacaatttgaagctgggtttacaagcttggcacatactgctgaagatatccaaaagacaatagcagcagccgaaaatgttctccggcagatttaa

SEQ ID NO: 468 - protein, 498 aa, Populus tremuloides
MAALSYNIFIIILTRHRLRMASTITGVSVGLGLSCSTTRKLTQKRNPSSSRLSFCSIKMAVSVEEEKKKKSFTLEKSEEAFSAAKEMMPGGVNSPVRAFKSVGGQPIVFDSVKGSHMRDIDGNDYIDYVGSWGPAIIGHADDEVLAALSETMKKGTSFGAPCLLENVLAEMVIKAVPSIEMVRFVNSGTEACMGVLRLARAYTGREKIIKFEGCYHGHADPFLVKAGSGVATLGLPDSPGVPKAATYETLTAPYNDIAAVENLFENNKGEICGIILEPVVGNAGFIPPKPEFINAIRRITEENNALLIFDEVMTGFRLSYGGAQEYFGITPDLTTLGKIIGGGLPVGAYGGRREIMEMVAPAGPMYQAGTLSGNPLAMTAGIHTLKRLQKPGSYEYLDKITSELVQGIIDAGKKTGHAICGGYIRGMFGFFFTEGPVYNFADAKKSDTAKFARFYQGMLREGVYFAPSQFEAGFTSLAHTAEDIQKTIAAAENVLRQI

SEQ ID NO: 469 - DNA, 1236 bp, Phaeodactylum tricornutum
atgcccggtggtgtttcgtcgccagtccgcgcgttcaagtccgtcggcggcaaccccgttgtctttgacaaggtcaagggagcctacgcctgggacgtggacggcaaccaatacattgattacgtcggaacctggggaccggctattctcggacacgccgatgacgacgtcctcgccgccattaccgaaaccatggccaagggaacttccttcggtgccccctgtcccttggagaacgagctcgccaaagccgtcattgccgccgtgccttccgtagaaatggtgcgattcaccaactctggtaccgaagcctgcatgggaatgattcgtttggtccgcgcacacacgggtcgggaaaaggtcatcaagttcgaaggatgctaccacggacacgccgattcatttttggtccaagccggatccggcgtcgccacgctcggtctccccgattcacccggggtccccaaggctgccaccagtgccactttctgcgccgagtacaacaacctcgaatcggtcaagaaaattttggaggaacacaaggacgagtttgccgccattattctcgaacccgtcgtgggcaattccggattcatcaagcccaccaaggagttcttgcagggtctgcgcgatttggccaccgaaaacggcgccctgctcgtctttgacgaagtcatgacgggattccgcgtcgcctacggaggtgctcaggagtactttggcgtcacccccgacgtcaccaccatgggcaaggtcattggcggtggactcccggtcggagcctacggtggccgcaaggatatcatggaaatggtcgccccggccggtcccatgtaccaggccggaactctctccggcaaccccctcgcgatgcgggcgggcatcgaaaccctcaaaaagctgagcgcccccggaacacacgaggaactcgaacgcaaatcccaaaaactgatcgacggcattgccgccgccgccgaaaaacacggccacgactttacttccgggtgtgccggaggtatgttcggatggttcttcaccaagggacccgtcaccaatttcagtgaggccgccaagtcggatagcgaaaaatttggcaaatggcaccgcatgatgctggaacggggtgtctacctggcgccgtccctatacgaagccggctttatgagtatggcacacacggatgcagatattgaaaagacaatcgccattgccgacgaagtcatggcaaagttgtaa

SEQ ID NO: 470 - protein, 411 aa, Phaeodactylum tricornutum
MPGGVSSPVRAFKSVGGNPVVFDKVKGAYAWDVDGNQYIDYVGTWGPAILGHADDDVLAAITETMAKGTSFGAPCPLENELAKAVIAAVPSVEMVRFTNSGTEACMGMIRLVRAHTGREKVIKFEGCYHGHADSFLVQAGSGVATLGLPDSPGVPKAATSATFCAEYNNLESVKKILEEHKDEFAAIILEPVVGNSGFIKPTKEFLQGLRDLATENGALLVFDEVMTGFRVAYGGAQEYFGVTPDVTTMGKVIGGGLPVGAYGGRKDIMEMVAPAGPMYQAGTLSGNPLAMRAGIETLKKLSAPGTHEELERKSQKLIDGIAAAAEKHGHDFTSGCAGGMFGWFFTKGPVTNFSEAAKSDSEKFGKWHRMMLERGVYLAPSLYEAGFMSMAHTDADIEKTIAIADEVMAKL

SEQ ID NO: 471 - DNA, 1422 bp, Ricinus communis
atggtgggtgctgctgcaatcacaggaataggaggtggattattagggttatcatgtacaaatctatcgcagagaagaccaacttctcgttgcagcagtatcaagatggctgtctctgtcgaagaagagaagaagaatttcactctcaagaaatctgaagaagcttttaatgttgctaaggagctaatgccaggaggtgtaaattcaccagtgagggcttttaaatcagttggtggacagcctattgtgatggattctgtaaagggttctcacatgtgggatattgatggcaatgagtatattgattacgttggttcttggggtcctgctattattggtcatgctgacgatcaggtacttgcagcgttggctgaaacaatgaagaaagggacaagctttggtgccccttgtcttctagagaatgtactagcagaaatggtgataaaagcagttccatgcattgaaatggttcgatttgtcaattctggaacagaggcttgcatgggtgttcttcgcctggcccgtgccttcactggccaggagaagcttatcaaatttgagggttgttaccatggccatgctgatcctttccttgtcaaggcaggaagtggtgttgcaacgctaggactgccagactccccaggtgttcctaaagcagcaacctttgaaactctaacggcccccttcaatgacatagctgctgtcgagaaactttttgaggcaaataagggagagattgcagcaataatccttgaacctgttgtaggaaattctggttttattccacctaaaccagatttccttaatgccatccgcagaatcaccaaagaaaataatgctcttctaatctttgatgaagttatgactggatttcgtttgtcatatggtggagctcaggaatattttggcataactcctgacctatcaacgctagggaagatcattggtggtggtttgccagttggtgcatatggaggaaggagggagattatggagatggttgcacctgcagggccaatgtaccaggctgggaccttgagtggaaatccactggcaatgacagctgggattcacactctcaagcgattgcaggagccaggaagttatgagtacttggataagaacaccggtgaacttatccagggcatattagatgctggcaagaaagctgggcatgccatgtgtggtgggcatataagtgggatgttcggatttttcttcacagaaggacctgtttacaacttttctgatgcaaagaaaagtgacactgcaaagtttgccaggttctaccagggaatgttggaagaaggtgtatactttgctccttcacaatttgaggctgggtttacaagcttggcacatactactgaagacatccaacgtacaataaaagcagctgagaaagttttccggcagatttag

SEQ ID NO: 472 - protein, 473 aa, Ricinus communis
MVGAAAITGIGGGLLGLSCTNLSQRRPTSRCSSIKMAVSVEEEKKNFTLKKSEEAFNVAKELMPGGVNSPVRAFKSVGGQPIVMDSVKGSHMWDIDGNEYIDYVGSWGPAIIGHADDQVLAALAETMKKGTSFGAPCLLENVLAEMVIKAVPCIEMVRFVNSGTEACMGVLRLARAFTGQEKLIKFEGCYHGHADPFLVKAGSGVATLGLPDSPGVPKAATFETLTAPFNDIAAVEKLFEANKGEIAAIILEPVVGNSGFIPPKPDFLNAIRRITKENNALLIFDEVMTGFRLSYGGAQEYFGITPDLSTLGKIIGGGLPVGAYGGRREIMEMVAPAGPMYQAGTLSGNPLAMTAGIHTLKRLQEPGSYEYLDKNTGELIQGILDAGKKAGHAMCGGHISGMFGFFFTEGPVYNFSDAKKSDTAKFARFYQGMLEEGVYFAPSQFEAGFTSLAHTTEDIQRTIKAAEKVFRQI

SEQ ID NO: 473 - DNA, 1449 bp, Solanum lycopersicum
atggctgctgtaaatggtgtaggactttcatggccatcaaaattgaccaaaaatcaaacacccaaatggggtttttctccatctcaccgtcgatgcaacccatcttcttcttcttcttctgcaaccattagaatgacagcctcagttgatgaaaagaagaaaacgttcacacttgagaagtctgaagaagctttcagcaaagccaaggagttgatgccaggaggtgtaaattcccctgtccgtgctttcaagtcagttggcggacaacctatcattattgactccgtgaagggctctcgtatgcgggacatagatggtaacgagtacattgactatgtcggatcatggggaccagctataattggtcatgcggatgatgaggtgctagcagcattggctgaaacaatgaagaaaggaacgagtttcggtgctccatgtctccttgaaaatacactggcagagatggttatttcagctgttccaagcatagaaatggttcgatttgtcaactctggtacagaagcatgtatgggagtactacggctggctcgtgctttcacttgccgtcctaagatcatcaaattcgagggttgttaccatggtcatgctgatccatttcttgttaaagcaggcagtggcgttgccaccctcggtcttcctgactctccgggagttccaaaggcagctactatcgatactctgaccgcaccttacaatgacatttctgctgttgagagcctctttgaggagcacaaaggagaaatagccgctgtaattctcgagcctgtagtcggaaatgctggcttcatcccacctaagctagaatttcttgctgccattcgcaagatcaccaaagagaatgatgcacttcttattttcgacgaagtcatgactggatttagattggcatatggcggtgctcaagagtattttggaataactccagatttgacaacactcgggaagattattggcggtggcttgccagtaggtgcttacggaggaagacgggatataatggagatggtagcacctgcaggaccaatgtatcaagctggcaccctaagtggaaacccattggccatgactgctggaattcacacgcttaagcggttacaaggacagggaacatacgaacacttggacaagatcaccgcggaacttacacaaggaatcttggatgctggaaagaagaccggtcatgcaatgtgtggtggctccataagggggatgtttggcttcttcttcgcggatggtcccatctataacttttcggatgcaaagaagagtgatacagaaaaatttggcagattctatagagggatgctggaggaaggtgtttactttgcaccatcacagtttgaggctggatttactagcttagcacacactccagaggatattcaaaggactgtagctgcagctgaaaaagttttgaagcaaatttaa

SEQ ID NO: 474 - protein, 482 aa, Solanum lycopersicum
MAAVNGVGLSWPSKLTKNQTPKWGFSPSHRRCNPSSSSSSATIRMTASVDEKKKTFTLEKSEEAFSKAKELMPGGVNSPVRAFKSVGGQPIIIDSVKGSRMRDIDGNEYIDYVGSWGPAIIGHADDEVLAALAETMKKGTSFGAPCLLENTLAEMVISAVPSIEMVRFVNSGTEACMGVLRLARAFTCRPKIIKFEGCYHGHADPFLVKAGSGVATLGLPDSPGVPKAATIDTLTAPYNDISAVESLFEEHKGEIAAVILEPVVGNAGFIPPKLEFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGQGTYEHLDKITAELTQGILDAGKKTGHAMCGGSIRGMFGFFFADGPIYNFSDAKKSDTEKFGRFYRGMLEEGVYFAPSQFEAGFTSLAHTPEDIQRTVAAAEKVLKQI

SEQ ID NO: 475 - DNA, 1431 bp, Selaginella moellendorffii
atggccgcggcgatggcgggtctctcggtggaatggagcgccttgctcggcgcgcccgcgtcgccatctccaaattgtcgcccgcgcccgcgtggatcggcttgccgagcttccggatcgcaaatggcggtgtccgtggagaagaaattcgtcacgcgcaagtccgaggagattttcaaggaggccaaggacttgatgccaggaggagtaaattcgccggttagagctttcaagtctgtgggtgggcagccgattatctttgatcgcgtcaaaggatcgcgagcttgggacgtggatggaaatgagtacgttgattatgttggcagctggggtcctgcgattataggccatgccgacgacgaggtacttaaagctctagccgaggctgcgaagaatggtacgagctttggtgctccctgtgccgcggagaacgagctcgcaaagctcgtaatcgacgcagtcccaagcgtggaaatggtccggtttgtcaactcgggcacagaggcgtgcatggggatgctgcggcttgcaagagccttcacggggcgagagaaagttatcaagtttgaaggctgctaccatggtcacgctgattcgttcctcgtcaaagctgggagcggtgttgcaacgcttggactcccggattcgcccggagtgcctaaaggagccacttcctcgacgcttactgcgggttacaacgatttggatgctgtgaagcagctcttccaagactacaaaggcgaggttgctgccgtagttctggagccagtcgtgggaaatgccgggttcatagctcccagtaaggagtttttggaaggattgagggaggtgacgaagaacgagggcgctcttctagttttcgacgaagtcatgaccggattcaggatagcttacggaggtgcacaggaatactttggcatcactccagacttgacaacgctgggtaaagtgattggtgggggactgcccgtcggtgcctacggtggaaagagggacatcatggagatggtagcaccggctggtcccatgtaccaagcaggtactctgagtggaaatcctttagcaatgactgctggaattcacacgctcaagcggctccagaactccgggacgtatgagtatctggacaaagtatcgggaaagctagttcaaggcctcctggaagctgggaagaatgcggggcatgatatgtgcggtggatacatccgggggatgtttggtttcttcttcactaaaggcccagtgcacaacttcgaggacgcaaagaagagcgacacggcaaagtttgcgaggtttcacagaggcatgctcgagcgaggcgtctatttggctccgtcccagtttgaagcgggttttacgagcttggctcacacggaagaggacattgacttcactctagccatggccaaggaagtactttccagcatttga

SEQ ID NO: 476 - protein, 476 aa, Selaginella moellendorffii
MAAAMAGLSVEWSALLGAPASPSPNCRPRPRGSACRASGSQMAVSVEKKFVTRKSEEIFKEAKDLMPGGVNSPVRAFKSVGGQPIIFDRVKGSRAWDVDGNEYVDYVGSWGPAIIGHADDEVLKALAEAAKNGTSFGAPCAAENELAKLVIDAVPSVEMVRFVNSGTEACMGMLRLARAFTGREKVIKFEGCYHGHADSFLVKAGSGVATLGLPDSPGVPKGATSSTLTAGYNDLDAVKQLFQDYKGEVAAVVLEPVVGNAGFIAPSKEFLEGLREVTKNEGALLVFDEVMTGFRIAYGGAQEYFGITPDLTTLGKVIGGGLPVGAYGGKRDIMEMVAPAGPMYQAGTLSGNPLAMTAGIHTLKRLQNSGTYEYLDKVSGKLVQGLLEAGKNAGHDMCGGYIRGMFGFFFTKGPVHNFEDAKKSDTAKFARFHRGMLERGVYLAPSQFEAGFTSLAHTEEDIDFTLAMAKEVLSSI

SEQ ID NO: 477 - DNA, 1377 bp, Triticum aestivum
atggccggagcagcagcagccgccgccgccgtggcgtccggcatctcgatccggccggtcgccgcgcctaagatctcgcgcgcgcctcgctctcggtcggcggtgagggcggccgtctccataggcgagaaggcttacacggttcagaaatctgaggagatcttcaacgccgccaaggaattgatgcctggaggtgttaattcaccagtccgtgccttcaaatcagtcggtgggcagcccatagtttttgattctgtgaagggctctcatatgtgggatgtggatggaaatgaatatattgattatgttggttcctggggtcctgcaatcattggtcatgcagatgatgaggtgaatgctgcacttattgaaactctgaagaagggaactagctttggtgctccatgtgcgttggagaatgtgttggctcaaatggtcatctccgctgtgccgagtatcgaaatggttcgttttgtaaattcaggaacagaagcttgcatgggagcactccgccttgtgcgtgcattcactgggagggaaaagatcctcaagtttgaaggctgttaccatggccatgcagattccttcctcgttaaagcaggcagtggtgttgccaccctcggcctcccagactcccctggagtgcctaagggagccaccgttgggactctaacagcaccttataatgatgttgaggcagttaaaaagctgtttgaggataacaaaggggagattgctgcagtcttccttgagccggttgtcggcaatgctggcttcattcctccgcagcctgctttcctaaatgctctccgtgaggtgaccaaacaagacggtgcacttctggtctttgatgaagtgatgactggtttccgtttagcttatggtggggcacaagagtactttggaatcacccctgacgtgacaaccttggggaaaattattggcggtggtcttccagttggtgcttacggtgggcggaaggaaatcatggagatggttgctccagcagggccaatgtaccaggcaggaaccctgagtggaaaccctctagctatgactgccggaatccacactctcaagcgtctgatggagcctggcacctatgaatacttggacaaggtcaccggtgaacttgtccaggggatattggatgcgggcgctaaaacagggcatgagatgtgtggaggacacatcaggggcatgttcggattcttcttcgcaggtggcccagtgcacaactttgatgacgccaagaagagcgacaccgcgaagttttgggaggttccaccgtgggatgctggaagaaggcgtgtatctggcaccgtcccagttcgaggcaggttttacaagcttggcacacacaaccctagacattga

SEQ ID NO: 478 - protein, 458 aa, Triticum aestivum
MAGAAAAAAAVASGISIRPVAAPKISRAPRSRSAVRAAVSIGEKAYTVQKSEEIFNAAKELMPGGVNSPVRAFKSVGGQPIVFDSVKGSHMWDVDGNEYIDYVGSWGPAIIGHADDEVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDVEAVKKLFEDNKGEIAAVFLEPVVGNAGFIPPQPAFLNALREVTKQDGALLVFDEVMTGFRLAYGGAQEYFGITPDVTTLGKIIGGGLPVGAYGGRKEIMEMVAPAGPMYQAGTLSGNPLAMTAGIHTLKRLMEPGTYEYLDKVTGELVQGILDAGAKTGHEMCGGHIRGMFGFFFAGGPVHNFDDAKKSDTAKFWEVPPWDAGRRRVSGTVPVRGRFYKLGTHNPRH

SEQ ID NO: 479 - DNA, 1236 bp, Thalassiosira pseudonana
atgcccggaggagtctcctctcccgtccgtgccttcaaatctgttggaggaaaccccatcgtttttgatagagtaaagggtgcttacgcgtgggatgttgacggcaacaaattcattgactacgtcggaacttggggacctgctattcttggacatgctgacgacgatgttttggatgctgtgaagaagaccatggacaagggaacatccttcggtgccccctgtgctctcgagaacgagcttgccaaggcagtcattgccgccgttccttccgtcgaaatggttcgtttcaccaactctggaaccgaagcatgcatgggtatgatccgtctctgtcgtgcctacactggacgcgaaaaggtcatcaaattcgaggggtgctaccacggacacgccgactccttcttggtccaggctggatctggtgttgccaccttgggtcttcccgacagtcctggtgtgccttccagtgccaccaaggccactctctgtgctgagtacaacaacttggacgctgtgaaagccatctttgaggagaataaggatgagatcgctgctctaattttggagcccgttgtaggaaactctggtttcatcaagcccgatattgagttccttgaggggcttcgtaagttggctactgataacggagctgttcttgtcttcgacgaggttatgactggattccgtgtggcttacggtggtgcccagcagtactttggagtcacccccgatttgacaaccatgggtaaggttattggaggaggattgccagttggagcttacggaggaaagaaggagatcatgcaaatggttgcccccgctgggcctatgtaccaggctggaaccttgtctggaaatcctcttgccatggttgccggaattgagacaatgaagaagttgcaacaacctggagtccacgacgagttggaaagaaagtccaagaagcttgtagacggcattgttgccaccgctaagaagcacggacttcctatctctggagaccaagctggaggtatgttcggatggtacttcgtcgagggacccgtcaagaacttcggacaagcagccaaggctgatgccgccatgttcggaaagtggcaccgtatgatgttggagagaggtgtttacttggctccttccatgtatgaggctggattcatgagtatgtcacacactgatgaagatattgagaggactattgctattgccgacgaggtcatggctcagttgtaa

SEQ ID NO: 480 - protein, 411 aa, Thalassiosira pseudonana
MPGGVSSPVRAFKSVGGNPIVFDRVKGAYAWDVDGNKFIDYVGTWGPAILGHADDDVLDAVKKTMDKGTSFGAPCALENELAKAVIAAVPSVEMVRFTNSGTEACMGMIRLCRAYTGREKVIKFEGCYHGHADSFLVQAGSGVATLGLPDSPGVPSSATKATLCAEYNNLDAVKAIFEENKDEIAALILEPVVGNSGFIKPDIEFLEGLRKLATDNGAVLVFDEVMTGFRVAYGGAQQYFGVTPDLTTMGKVIGGGLPVGAYGGKKEIMQMVAPAGPMYQAGTLSGNPLAMVAGIETMKKLQQPGVHDELERKSKKLVDGIVATAKKHGLPISGDQAGGMFGWYFVEGPVKNFGQAAKADAAMFGKWHRMMLERGVYLAPSMYEAGFMSMSHTDEDIERTIAIADEVMAQL

SEQ ID NO: 481 - DNA, 1395 bp, Volvox carteri
atgcagtcgctgaaggcgaagacggttcaggcccagcgccccttcactgcgcagcgccctcgcgctgttcgcggtagcgtctccgttcgcgccgttgccgctccgccacggctaattacgaagcgctccgaggagattttcaaggaggcccaggagcttttgccaggcggtgtcaactcgcctgtgcgtgcattccgttccgtgggtggcggccccattgtcttcgatcgcgttaagggcgcctactgctatgatgtcgatggcaacaagtacatcgactatgttggcagctggggtccggctatcgttggccatgctaatgatgaggtcaacgaagccctcaaggcacaaatcgagaagggtaccagcttcggcgcgccctgcgagctggagaacgtcctggccaagatggtaatcgaccgcgtgccgtccgtggagatggtccgcttcgtgtcctctggcacggaggcgtgcctgtcggtgctgcgcctaatgcgcgcttacactggccgcgagaagatcattaaattcactggctgctaccatggccacgccgactccttcttggtgaaggctggatccggtgtcattaccttgggcctgccagacagccctggtgtgcccaagagcaccgccgccgccacgctgacagccacgtacaacgacctggcgtcggtccgggagctgttcgcggccaacaagggcgagattgctggtttgattttggagccggttgtgggcaacagcggcttcattgtgccgaccaaggagttcctgcaggggttgagggacatttgcacggcggagggagctgtgctgtgcttcgatgaggtcatgacaggcttccgcattgctaagggctgtgcccaggagtacttcggtattacgcccgacttgactactatgggcaaggtcatcggcggtggcctgcctgtcggcgcgtacggcggcaagaaggagataatgaagatggtggcacccgcgggccccatgtaccaggccggtaccctgtcgggcaacccgatggccatgactgcgggcatcaagacgcttgagattctgggccgcccgggcgcctacgagtacctggagaagatcaccgagcgcctcattgacggcatcatggcggctgccaaggagcacggccacgagatcaccggtggaaacatcagtggcatgttcggcttcttcttctgcaaggggccggtgtcctgctttgaggacgcccttgctgctgatacggccaagttcgcacgcttccaccgtgccatgcttgaggagggcgtatacctcgcgccatcacagtttgaggccggcttcacgagcttggcgcataccgatgcggacgtggatgccacaattgctgccgctcgccgcgccttcgcacgcatctaa

SEQ ID NO: 482 - protein, 464 aa, Volvox carteri
MQSLKAKTVQAQRPFTAQRPRAVRGSVSVRAVAAPPRLITKRSEEIFKEAQELLPGGVNSPVRAFRSVGGGPIVFDRVKGAYCYDVDGNKYIDYVGSWGPAIVGHANDEVNEALKAQIEKGTSFGAPCELENVLAKMVIDRVPSVEMVRFVSSGTEACLSVLRLMRAYTGREKIIKFTGCYHGHADSFLVKAGSGVITLGLPDSPGVPKSTAAATLTATYNDLASVRELFAANKGEIAGLILEPVVGNSGFIVPTKEFLQGLRDICTAEGAVLCFDEVMTGFRIAKGCAQEYFGITPDLTTMGKVIGGGLPVGAYGGKKEIMKMVAPAGPMYQAGTLSGNPMAMTAGIKTLEILGRPGAYEYLEKITERLIDGIMAAAKEHGHEITGGNISGMFGFFFCKGPVSCFEDALAADTAKFARFHRAMLEEGVYLAPSQFEAGFTSLAHTDADVDATIAAARRAFARI

SEQ ID NO: 483 - DNA, 1422 bp, Vypha shuttleworthii
atggcgagcgtatctggaggagtggctctctcatgcccatcaaggctctctcacagatcctcttcttcatctcatcgccgccatgtctcttcttcttccgtcaaaatggcagtttcagttgatgagaagaagaagagtttcactcttcaaaaatctgaagaggccttcgaaatcgctaaggagttgatgcctggtggtgtgaattcacctgttcgtgccttcaaatcagttggtggacaacctattttgtttgattctgtcaagggctctcacatgtgggacatagatggcaatgaatacattgactacgttggttcatgggggccagcaatcattggtcatgctgatgatgaggtactggcagccttggctgaaacaatgaagaaaggaacaagctttggtgccccttgtcttctggagaatattctggccgagatggttatatctgctgttccaagcatagagatggttcgctttgttaactcgggtactgaagcatgcatgggcatgctccgcctagcccgtgccttcactggcaaggagaaaatcataaagtttgagggttgctaccatggccatgccgatccgttccttgtcaaggcaggcagtggagttgcaaccctggggctacctgactcacctggtgttcccagggcagccacctttgaaactctaacatcacccttcaatgacttatcaactgtggaaaaactcttcgaggcgaataaaggagagattgcagcagtcatccttgaacctgttgttggaaactctggcttcatagctcccaaacctgacttcctgaatgctctccaagaaatcaccaaagaaaatggtgctctccttgtctttgatgaagttatgacaggtttccgcatatcttatggtggtgcccaggaatactttggcattacacctgatataacaacacttggaaagatcattggtggtggcctgcctgttggtgcatatggaggaaggagggagatcatggagttggtggcaccagcaggcccaatgtaccaggcaggaaccttgagtgggaacccattggcaatgacagcaggcatccaaacactaaagcggttgaaggagccaggatcatacgagtacttggataaaatcacaggtgaacttattcagggcattttggatgctggaaaaaaggctgggcatgccatatgtggtgggtatattagtgggatgcttgggtttttcttcacagagggacctgtttacaactttggggatgcaaagaatagtgatacagcaaaatttgcaaggttttataggggaatgctggaggaaggtgtttactttgcaccttcccagtttgaggctgggtttactagcttggcacatacacctgaagatatccaacaaacgatagcagcagctgagaaggttttccggcaaatttag

SEQ ID NO: 484 - protein, 473 aa, Vypha shuttleworthii
MASVSGGVALSCPSRLSHRSSSSSHRRHVSSSSVKMAVSVDEKKKSFTLQKSEEAFEIAKELMPGGVNSPVRAFKSVGGQPILFDSVKGSHMWDIDGNEYIDYVGSWGPAIIGHADDEVLAALAETMKKGTSFGAPCLLENILAEMVISAVPSIEMVRFVNSGTEACMGMLRLARAFTGKEKIIKFEGCYHGHADPFLVKAGSGVATLGLPDSPGVPRAATFETLTSPFNDLSTVEKLFEANKGEIAAVILEPVVGNSGFIAPKPDFLNALQEITKENGALLVFDEVMTGFRISYGGAQEYFGITPDITTLGKIIGGGLPVGAYGGRREIMELVAPAGPMYQAGTLSGNPLAMTAGIQTLKRLKEPGSYEYLDKITGELIQGILDAGKKAGHAICGGYISGMLGFFFTEGPVYNFGDAKNSDTAKFARFYRGMLEEGVYFAPSQFEAGFTSLAHTPEDIQQTIAAAEKVFRQI

SEQ ID NO: 485 - DNA, 1425 bp, Zea mays
atggccggagcagcagcagccgccgccgtggcgtccggggtctcggcccggccggccgcgccgaggagggcttctgcgggacgccgcgctcggctgtcggtggtgcgggccgcgatatccctcgagaagggcgagaaggcgtacacggtgcagaagtccgaggagatcttcaacgccgccaaggagctgatgcctggaggtgttaattcgccggtccgtgccttcaaatctgttggtgggcagccagtagtgttcgactctgtaaagggttctcgtatgtgggatgttgatgggaatgagtacattgattacgttggttcctggggtcctgcaatcatcggccatgcagatgataaggttaatgctgcattgattgaaactctgaagaaaggaactagctttggtgctccatgtttgctggagaacgtattggctgagatggtcatctctgccgtgccaagtatcgaaatggtccgctttgtcaactcagggacagaagcctgcatgggagcgctccgcctcgtgcgcgcattcaccgggcgggagaagatcatcaagttcgaaggctgctaccatggccatgccgattccttccttgtcaaagctggcagtggtgtcgccacccttggcctcccagactcccctggcgtccccaagggggccacctacgagactctaacggcaccctacaatgatgtcgaggcagtgaagaaactgttcgaggacaacgcgggggagattgctgccgtcttcctcgagccagttgttggcaacgctggtttcatccccccacagcctggtttccttaacgctctccgcgacttgaccaaacaggatggtgcgctcctggtcttcgatgaagtgatgaccggcttccgtctgtcttacggtggagctcaggagtacttcgggatcacccctgacgtgacgaccttgggcaagatcatcgggggtggcctccccgttggtgcctacggtgggagaagggacatcatggagatggttgcccccgcagggccgatgtaccaggcaggaactctcagcgggaaccctctagccatgaccgctgggatccacacgctcaagcggctgacagagcccggcacctacgagtacttggacaagatcaccggcgaactcgtccgtgggatactggacgtcggtgcgaaagcagggcatgagatgtgcggaggacatatcagaggaatgtttggcttcttcttcaccggcgggcccgtccacaatttcggggacgccaagaagagcgacaccgagaagttcgggaggttctaccgtggcatgctggaggagggcgtgtacttcgctccatcgcagttcgaggcggggttcaccagcttggcgcacacctcccaggacatcgagaagaccgtcgaggccgctgagaaggttctgaagcggatatag

SEQ ID NO: 486 - protein, 474 aa, Zea mays
MAGAAAAAAVASGVSARPAAPRRASAGRRARLSVVRAAISLEKGEKAYTVQKSEEIFNAAKELMPGGVNSPVRAFKSVGGQPVVFDSVKGSRMWDVDGNEYIDYVGSWGPAIIGHADDKVNAALIETLKKGTSFGAPCLLENVLAEMVISAVPSIEMVRFVNSGTEACMGALRLVRAFTGREKIIKFEGCYHGHADSFLVKAGSGVATLGLPDSPGVPKGATYETLTAPYNDVEAVKKLFEDNAGEIAAVFLEPVVGNAGFIPPQPGFLNALRDLTKQDGALLVFDEVMTGFRLSYGGAQEYFGITPDVTTLGKIIGGGLPVGAYGGRRDIMEMVAPAGPMYQAGTLSGNPLAMTAGIHTLKRLTEPGTYEYLDKITGELVRGILDVGAKAGHEMCGGHIRGMFGFFFTGGPVHNFGDAKKSDTEKFGRFYRGMLEEGVYFAPSQFEAGFTSLAHTSQDIEKTVEAAEKVLKRI

SEQ ID NO: 487 - protein, 50 aa, Artificial sequence
  domain 1
  VARIANT (4)..(4): / replace = "Val"
  VARIANT (18)..(18): / replace = "Leu"
  VARIANT (19)..(19): / replace = "Ser"
  VARIANT (24)..(24): / replace = "Met"
  VARIANT (27)..(27): / replace = "Tyr"
  VARIANT (33)..(33): / replace = "Val"
  VARIANT (34)..(34): / replace = "Leu"
  VARIANT (46)..(46): / replace = "Ser"
VPSIEMVRFVNSGTEACMGVLRLARAFTGREKIIKFEGCYHGHADPFLVK

SEQ ID NO: 488 - protein, 50 aa, Artificial sequence
  domain 2
  VARIANT (15)..(15): / replace = "Val"
  VARIANT (17)..(17): / replace = "Ile"
  VARIANT (19)..(19): / replace = "Arg"
  VARIANT (23)..(23): / replace = "Ala"
  VARIANT (24)..(24): / replace = "Arg" / replace = "Tyr"
  VARIANT (25)..(25): / replace = "Ala"
  VARIANT (28)..(28): / replace = "Val"
  VARIANT (32)..(32): / replace = "Lys"
  VARIANT (34)..(34): / replace = "Val"
NSPVRAFKSVGGQPIVFDSVKGSHMWDIDGNEYIDYVGSWGPAIIGHADD

SEQ ID NO: 489 - protein, 50 aa, Artificial sequence
  domain 3
  VARIANT (11)..(11): / replace = "Val"
  VARIANT (14)..(14): / replace = "Met"
  VARIANT (17)..(17): / replace = "Val"
  VARIANT (30)..(30): / replace = "Lys"
  VARIANT (31)..(31): / replace = "Lys"
  VARIANT (32)..(32): / replace = "Glu"
AQEYFGITPDLTTLGKIIGGGLPVGAYGGRREIMEMVAPAGPMYQAGTLS

SEQ ID NO: 490 - DNA, 56 bp, Artificial sequence
  primer: prm12181
ggggacaagtttgtacaaaaaagcaggcttaaacaatggcttctacaatcacagga

SEQ ID NO: 491 - DNA, 50 bp, Artificial sequence
  primer: prm12182
ggggaccactttgtacaagaaagctgggtcaacaatcacacagcgagata

SEQ ID NO: 492 - DNA, 2194 bp, Oryza sativa; identical to SEQ ID NO: 103

The invention claimed is:

1. A method for enhancing a yield-related trait in a plant relative to a corresponding control plant, comprising transforming and expressing in the plant a nucleic acid encoding a Calreticulin polypeptide comprising the amino acid sequence of SEQ ID NO: 105, wherein the introduction of said nucleic acid results in an enhanced yield-related trait relative to a control plant.

2. The method of claim 1, wherein the nucleic acid comprises the nucleotide sequence of SEQ ID NO:104.

3. The method of claim 1, wherein said enhanced yield-related trait comprises increased yield, increased seed yield, increased seed yield per plant, increased number of filled seeds, increased total number of seeds, increased harvest index, increased biomass, and/or increased aboveground biomass relative to a corresponding control plant.

4. The method of claim 1, wherein said enhanced yield-related trait is obtained under non-stress conditions.

5. The method of claim 1, wherein said enhanced yield-related trait is obtained under conditions of drought stress, salt stress, nitrogen deficiency, or reduced nutrient availability.

6. The method of claim 1, wherein said nucleic acid is operably linked to a constitutive promoter, a GOS2 promoter, a GOS2 promoter from rice, or a promoter comprising the nucleotide sequence of SEQ ID NO: 295.

7. The method of claim 1, wherein the nucleic acid encoding a Calreticulin polypeptide is of plant origin, from a dicotyledonous plant, from a plant of the family Solanaceae, from a plant of the genus *Solanum*, or from a *Solanum lycopersicum* plant.

8. A method for making a pant having an increased yield-related trait relative to a corresponding control plant, comprising transforming a plant or a plant cell with a construct comprising (i) a nucleic acid sequence encoding a Calreticulin polypeptide comprising the amino acids sequence of SEQ ID NO: 105; (ii) one or more heterologous control sequences capable of driving expression of the nucleic acid sequence of (i); and optionally (iii) a transcription termination sequence, wherein the increased yield-related trait is one or more of increased yield, increased biomass, increased aboveground biomass, increased seed yield, increased seed yield per plant, increased number of filled seeds, increased total number of seeds, and increased harvest index.

9. A plant produced by the method of claim 8.

10. A method for the production of a transgenic plant having an enhanced yield-related trait relative to a corresponding control plant, comprising:
(i) introducing and expressing in a plant a nucleic acid encoding a Calreticulin polypeptide comprising the amino acid sequence of SEQ ID NO: 105; and
(ii) cultivating the plant under conditions promoting plant growth and development, wherein the enhanced yield-related trait is one or more of increased yield, increased seed yield, increased biomass, or increased harvest index.

11. The method of claim 8, further comprising selecting for a plant having an increased yield-related trait relative to a corresponding control plant.

12. The method of claim 10, further comprising selecting for a plant having an increased yield-related trait relative to a corresponding control plant.

13. The method of claim 10, wherein said nucleic acid comprises the nucleotide sequence of SEQ ID NO: 104.

14. The method of claim 8, wherein one of said control sequences is a constitutive promoter, a GOS2 promoter, a GOS2 promoter from rice, or a promoter comprising the nucleotide sequence of SEQ ID NO: 295.

\* \* \* \* \*